(12) United States Patent
Choi et al.

(10) Patent No.: US 6,887,663 B1
(45) Date of Patent: May 3, 2005

(54) STREPTOCOCCUS PNEUMONIAE SP036 POLYNUCLEOTIDES

(75) Inventors: Gil H. Choi, Rockville, MD (US); Charles A. Kunsch, Norcross, GA (US); Steven C. Barash, Rockville, MD (US); Patrick J. Dillion, Carlsbad, CA (US); Brian Dougherty, Killingworth, CT (US); Michael R. Fannon, Silver Spring, MD (US); Craig A. Rosen, Laytonsville, MD (US)

(73) Assignee: Human Genome Sciences, Inc., Rockville, MD (US)

( * ) Notice: Subject to any disclaimer, the term of this patent is extended or adjusted under 35 U.S.C. 154(b) by 139 days.

(21) Appl. No.: 09/765,271

(22) Filed: Jan. 22, 2001

Related U.S. Application Data

(63) Continuation of application No. 09/536,784, filed on Mar. 28, 2000, now Pat. No. 6,573,082, which is a continuation of application No. 08/961,083, filed on Oct. 30, 1997.
(60) Provisional application No. 60/029,960, filed on Oct. 31, 1996.

(51) Int. Cl.⁷ .......................... C12Q 1/68; C12P 21/06; C12N 15/00; C07H 21/04
(52) U.S. Cl. .................. 435/6; 435/69.1; 435/69.7; 435/70.1; 435/471; 435/325; 435/252.3; 435/254.11; 435/257.2; 435/320.1; 536/23.7; 935/23; 935/24

(58) Field of Search .................... 435/6, 69.1, 69.7, 435/70.1, 471, 325, 252.3, 254.11, 257.2, 320.1, 69.3, 440; 935/23, 24, 6.8, 9, 11, 12, 22, 52, 66; 536/23.7; 530/350; 534/23.1, 23.7, 24.32

(56) References Cited

U.S. PATENT DOCUMENTS 5,302,527 A * 4/1994 Birkett et al.
5,534,410 A * 7/1996 Tjian et al.
6,420,135 B1 * 7/2002 Kunsch et al.
2002/0061545 A1 * 5/2002 Choi et al.
2004/0029118 A1 * 2/2004 Kunsch et al.

OTHER PUBLICATIONS

Stratagene 1991 Product Catalog p. 66, 1991.*
Boehringer Mannheim Biochemicals 1991 Catalog p. 557.*
Watson et al "Molecular Biology of the Gene" 4th Ed. p. 608 Benjamin—Cummings Publishing Co., 1987.*

* cited by examiner

Primary Examiner—Patricia A. Duffy
(74) Attorney, Agent, or Firm—Human Genome Sciences, Inc.

(57) ABSTRACT

The present invention relates to novel vaccines for the prevention or attenuation of infection by Streptococcus pneumoniae. The invention further relates to isolated nucleic acid molecules encoding antigenic polypeptides of Streptococcus pneumoniae. Antigenic polypeptides are also provided, as are vectors, host cells and recombinant methods for producing the same. The invention additionally relates to diagnostic methods for detecting Streptococcus nucleic acids, polypeptides and antibodies in a biological sample.

43 Claims, No Drawings

STREPTOCOCCUS PNEUMONIAE SP036 POLYNUCLEOTIDES

This application is a continuation of and claims benefit under 35 U.S.C. § 120 to U.S. patent application Ser. No: 09/536,784, filed Mar. 28, 2000, now U.S. Pat. No. 6,573,082, which is a continuation of U.S. patent application Ser. No: 08/961,083, filed Oct. 30, 1997, which claims benefit under 35 U.S.C. § 119(e) of U.S. Provisional application No: 60/029,960, filed Oct. 31, 1996.

FIELD OF THE INVENTION

The present invention relates to novel *Streptococcus pneumoniae* antigens for the detection of *Streptococcus* and for the prevention or attenuation of disease caused by *Streptococcus*. The invention further relates to isolated nucleic acid molecules encoding antigenic polypeptides of *S. pneumoniae*. Antigenic polypeptides are also provided, as are vectors, host cells and recombinant methods for producing the same. The invention additionally relates to diagnostic methods for detecting *Streptococcus* gene expression.

BACKGROUND OF THE INVENTION

*Streptococcus pneumoniae* has been one of the most extensively studied microorganisms since its first isolation in 1881. It was the object of many investigations that led to important scientific discoveries. In 1928, Griffith observed that when heat-killed encapsulated pneumococci and live strains constitutively lacking any capsule were concomitantly injected into mice, the nonencapsulated could be converted into encapsulated pneumococci with the same capsular type as the heat-killed strain. Years later, the nature of this "transforming principle," or carrier of genetic information, was shown to be DNA. (Avery, O. T., et al., *J. Exp. Med.*, 79:137–157 (1944)).

In spite of the vast number of publications on *S. pneumoniae* many questions about its virulence are still unanswered, and this pathogen remains a major causative agent of serious human disease, especially community-acquired pneumonia (Johnston, R. B., et al., *Rev. Infect. Dis.* 13(Suppl. 6):S509–517 (1991)). In addition, in developing countries, the pneumococcus is responsible for the death of a large number of children under the age of 5 years from pneumococcal pneumonia. The incidence of pneumococcal disease is highest in infants under 2 years of age and in people over 60 years of age. Pneumococci are the second most frequent cause (after *Haemophilus influenzae* type b) of bacterial meningitis and otitis media in children. With the recent introduction of conjugate vaccines for *H. influenza* type b, pneumococcal meningitis is likely to become increasingly prominent. *S. pneumoniae* is the most important etiologic agent of community-acquired pneumonia in adults and is the second most common cause of bacterial meningitis behind *Neisseria meningitidis*.

The antibiotic generally prescribed to treat *S. pneumoniae* is benzylpenicillin, although resistance to this and to other antibiotics is found occasionally. Pneumococcal resistance to penicillin results from mutations in its penicillin-binding proteins. In uncomplicated pneumococcal pneumonia caused by a sensitive strain, treatment with penicillin is usually successful unless started too late. Erythromycin or clindamycin can be used to treat pneumonia in patients hypersensitive to penicillin, but resistant strains to these drugs exist. Broad spectrum antibiotics (e.g., the tetracyclines) may also be effective, although tetracycline-resistant strains are not rare. In spite of the availability of antibiotics, the mortality of pneumococcal bacteremia in the last four decades has remained stable between 25 and 29%. (Gillespie, S. H., et al., *J. Med Microbiol.* 28:237–248 (1989)).

*S. pneumoniae* is carried in the upper respiratory tract by many healthy individuals. It has been suggested that attachment of pneumococci is mediated by a disaccharide receptor on fibronectin, present on human pharyngeal epithelial cells. (Anderson, B. J., et al., *J. Immunol.* 142:246–2468 (1989). The mechanisms by which pneumococci translocate from the nasopharynx to the lung, thereby causing pneumonia, or migrate to the blood, giving rise to bacteremia or septicemia, are poorly understood. (Johnston, R. B., et al., *Rev. Infect. Dis.* 13(Suppl. 6):S509–517 (1991).

Various proteins have been suggested to be involved in the pathogenicity of *S. pneumoniae*, however, only a few of them have actually been confirmed as virulence factors. Pneumococci produce an IgA1 protease that might interfere with host defense at mucosal surfaces. (Kornfield, S. J., et al., *Rev. Inf. Dis.* 3:521–534 (1981). *S. pneumoniae* also produces neuramimidase, an enzyme that may facilitate attachment to epithelial cells by cleaving sialic acid from the host glycolipids and gangliosides. Partially purified neuramimidase was observed to induce meningitis-like symptoms in mice; however, the reliability of this finding has been questioned because the neuramimidase preparations used were probably contaminated with cell wall products. Other pneumococcal proteins besides neuramimidase are involved in the adhesion of pneumococci to epithelial and endothelial cells. These pneumococcal proteins have as yet not been identified. Recently, Cundell et al., reported that peptide permeases can modulate pneumococcal adherence to epithelial and endothelial cells. It was, however, unclear whether these permeases function directly as adhesions or whether they enhance adherence by modulating the expression of pneumococcal adhesions. (DeVelasco, E. A., et al., *Micro. Rev.* 59:591–603 (1995). A better understanding of the virulence factors determining its pathogenicity will need to be developed to cope with the devastating effects of pneumococcal disease in humans.

Ironically, despite the prominent role of *S. pneumoniae* in the discovery of DNA, little is known about the molecular genetics of the organism. The *S. pneumoniae* genome consists of one circular, covalently closed, double-stranded DNA and a collection of so-called variable accessory elements, such as prophages, plasmids, transposons and the like. Most physical characteristics and almost all of the genes of *S. pneumoniae* are unknown. Among the few that have been identified, most have not been physically mapped or characterized in detail. Only a few genes of this organism have been sequenced. (See, for instance current versions of GENBANK and other nucleic acid databases, and references that relate to the genome of *S. pneumoniae* such as those set out elsewhere herein.) Identification of in vivo-expressed, and broadly protective, antigens of *S. pneumoniae* has remained elusive.

SUMMARY OF THE INVENTION

The present invention provides isolated nucleic acid molecules comprising polynucleotides encoding the *S. pneumoniae* polypeptides described in Table 1 and having the amino acid sequences shown as SEQ ID NO:2, SEQ ID NO:4, SEQ ID NO:6, and so on through SEQ ID NO:226. Thus, one aspect of the invention provides isolated nucleic acid molecules comprising polynucleotides having a nucleotide sequence selected from the group consisting of: (a) a nucleotide sequence encoding any of the amino acid sequences of the polypeptides shown in Table 1; and (b) a nucleotide sequence complementary to any of the nucleotide sequences in (a).

Further embodiments of the invention include isolated nucleic acid molecules that comprise a polynucleotide having a nucleotide sequence at least 90% identical, and more preferably at least 95%, 96%, 97%, 98% or 99% identical to any of the nucleotide sequences in (a) or (b) above, or a polynucleotide which hybridizes under stringent hybridization conditions to a polynucleotide in (a) or (b) above. This polynucleotide which hybridizes does not hybridize under stringent hybridization conditions to a polynucleotide having a nucleotide sequence consisting of only A residues or of only T residues. Additional nucleic acid embodiments of the invention relate to isolated nucleic acid molecules comprising polynucleotides which encode the amino acid sequences of epitope-bearing portions of an *S. pneumoniae* polypeptide having an amino acid sequence in (a) above.

The present invention also relates to recombinant vectors, which include the isolated nucleic acid molecules of the present invention, and to host cells containing the recombinant vectors, as well as to methods of making such vectors and host cells and for using these vectors for the production of *S. pneumoniae* polypeptides or peptides by recombinant techniques.

The invention further provides isolated *S. pneumoniae* polypeptides having an amino acid sequence selected from the group consisting of an amino acid sequence of any of the polypeptides described in Table 1.

The polypeptides of the present invention also include polypeptides having an amino acid sequence with at least 70% similarity, and more preferably at least 75%, 80%, 85%, 90%, 95%, 96%, 97%, 98%, or 99% similarity to those described in Table 1, as well as polypeptides having an amino acid sequence at least 70% identical, more preferably at least 75% identical, and still more preferably 80%, 85%, 90%, 95%, 96%, 97%, 98%, or 99% identical to those above; as well as isolated nucleic acid molecules encoding such polypeptides.

The present invention further provides a vaccine, preferably a multi-component vaccine comprising one or more of the *S. pneumoniae* polynucleotides or polypeptides described in Table 1, or fragments thereof, together with a pharmaceutically acceptable diluent, carrier, or excipient, wherein the *S. pneumoniae* polypeptide(s) are present in an amount effective to elicit an immune response to members of the *Streptococcus* genus in an animal. The *S. pneumoniae* polypeptides of the present invention may further be combined with one or more immunogens of one or more other streptococcal or non-streptococcal organisms to produce a multi-component vaccine intended to elicit an immunological response against members of the *Streptococcus* genus and, optionally, one or more non-streptococcal organisms.

The vaccines of the present invention can be administered in a DNA form, e.g., "naked" DNA, wherein the DNA encodes one or more streptococcal polypeptides and, optionally, one or more polypeptides of a non-streptococcal organism. The DNA encoding one or more polypeptides may be constructed such that these polypeptides are expressed fusion proteins.

The vaccines of the present invention may also be administered as a component of a genetically engineered organism. Thus, a genetically engineered organism which expresses one or more *S. pneumoniae* polypeptides may be administered to an animal. For example, such a genetically engineered organism may contain one or more *S. pneumoniae* polypeptides of the present invention intacellularly, on its cell surface, or in its periplasmic space. Further, such a genetically engineered organism may secrete one or more *S. pneumoniae* polypeptides.

The vaccines of the present invention may be co-administered to an animal with an immune system modulator (e.g., CD86 and GM-CSF).

The invention also provides a method of inducing an immunological response in an animal to one or more members of the *Streptococcus* genus, preferably one or more isolates of the *S. pneumoniae* genus, comprising administering to the animal a vaccine as described above.

The invention further provides a method of inducing a protective immune response in an animal, sufficient to prevent or attenuate an infection by members of the *Streptococcus* genus, preferably at least *S. pneumoniae*, comprising administering to the animal a composition comprising one or more of the polynucleotides or polypeptides described in Table 1, or fragments thereof. Further, these polypeptides, or fragments thereof, may be conjugated to another immunogen and/or administered in admixture with an adjuvant.

The invention further relates to antibodies elicited in an animal by the administration of one or more *S. pneumoniae* polypeptides of the present invention and to methods for producing such antibodies.

The invention also provides diagnostic methods for detecting the expression of genes of members of the *Streptococcus* genus in an animal. One such method involves assaying for the expression of a gene encoding *S. pneumoniae* peptides in a sample from an animal. This expression may be assayed either directly (e.g., by assaying polypeptide levels using antibodies elicited in response to amino acid sequences described in Table 1) or indirectly (e.g., by assaying for antibodies having specificity for amino acid sequences described in Table 1). An example of such a method involves the use of the polymerase chain reaction (PCR) to amplify and detect *Streptococcus* nucleic acid sequences.

The present invention also relates to nucleic acid probes having all or part of a nucleotide sequence described in Table 1 (shown as SEQ ID NO:1, SEQ ID NO:3, SEQ ID NO:5, and so on through SEQ ID NO:225) which are capable of hybridizing under stringent conditions to *Streptococcus* nucleic acids. The invention further relates to a method of detecting one or more *Streptococcus* nucleic acids in a biological sample obtained from an animal, said one or more nucleic acids encoding *Streptococcus* polypeptides, comprising: (a) contacting the sample with one or more of the above described nucleic acid probes, under conditions such that hybridization occurs, and (b) detecting hybridization of said one or more probes to the *Streptococcus* nucleic acid present in the biological sample.

The invention also includes immunoassays, including an immunoassay for detecting *Streptococcus*, preferably at least isolates of the *S. pneumoniae* genus, comprising incubation of a sample (which is suspected of being infected with *Streptococcus*) with a probe antibody directed against an antigen/epitope of *S. pneumoniae*, to be detected under conditions allowing the formation of an antigen-antibody complex; and detecting the antigen-antibody complex which contains the probe antibody. An immunoassay for the detection of antibodies which are directed against a *Streptococcus* antigen comprising the incubation of a sample (containing antibodies from a mammal suspected of being infected with

*Streptococcus*) with a probe polypeptide including an epitope of *S. pneumoniae*, under conditions that allow the formation of antigen-antibody complexes which contain the probe epitope containing antigen.

Some aspects of the invention pertaining to kits are those for investigating samples for the presence of polynucleotides derived from *Streptococcus* which comprise a polynucleotide probe including a nucleotide sequence selected from Table 1 or a fragment thereof of approximately 15 or more nucleotides, in an appropriate container, analyzing the samples for the presence of antibodies directed against a *Streptococcus* antigen made up of a polypeptide which contains a *S. pneumoniae* epitope present in the polypeptide, in a suitable container, and analyzing samples for the presence of *Streptococcus* antigens made up of an anti-*S. pneumoniae* antibody, in a suitable container.

DETAILED DESCRIPTION

The present invention relates to recombinant antigenic *S. pneumoniae* polypeptides and fragments thereof. The invention also relates to methods for using these polypeptides to produce immunological responses and to confer immunological protection to disease caused by members of the genus *Streptococcus*, at least isolates of the *S. pneumoniae* genus. The invention further relates to nucleic acid sequences which encode antigenic *S. pneumoniae* polypeptides and to methods for detecting *S. pneumoniae* nucleic acids and polypeptides in biological samples. The invention also relates to *S. pneumoniae-specific* antibodies and methods for detecting such antibodies produced in a host animal.

Definitions

The following definitions are provided to clarify the subject matter which the inventors consider to be the present invention.

As used herein, the phrase "pathogenic agent" means an agent which causes a disease state or affliction in an animal. Included within this definition, for examples, are bacteria, protozoans, fungi, viruses and metazoan parasites which either produce a disease state or render an animal infected with such an organism susceptible to a disease state (e.g., a secondary infection). Further included are species and strains of the genus *Streptococcus* which produce disease states in animals.

As used herein, the term "organism" means any living biological system, including viruses, regardless of whether it is a pathogenic agent.

As used herein, the term "*Streptococcus*" means any species or strain of bacteria which is members of the genus *Streptococcus*. Such species and strains are known to those of skill in the art, and include those that are pathogenic and those that are not.

As used herein, the phrase "one or more *S. pneumoniae* polypeptides of the present invention" means polypeptides comprising the amino acid sequence of one or more of the *S. pneumoniae* polypeptides described in Table 1 and disclosed as SEQ ID NO:2, SEQ ID NO:4, SEQ ID NO:6, and so on through SEQ ID NO:226. These polypeptides may be expressed as fusion proteins wherein the *S. pneumoniae* polypeptides of the present invention are linked to additional amino acid sequences which may be of streptococcal or non-streptococcal origin. This phrase further includes polypeptide comprising fragments of the *S. pneumoniae* polypeptides of the present invention.

Additional definitions are provided throughout the specification.

Explanation of Table 1

Table 1, below, provides information describing 113 open reading frames (ORFs) which encode potentially antigenic polypeptides of *S. pneumoniae* of the present invention. The table lists the ORF identifier which consists of the letters SP, which denote *S. pneumoniae*, followed immediately by a three digit numeric code, which arbitrarily number the potentially antigenic polypeptides of *S. pneumoniae* of the present invention and the nucleotide or amino acid sequence of each ORF and encoded polypeptide. The table further correlates the ORF identifier with a sequence identification number (SEQ ID NO:). The actual nucleotide or amino acid sequence of each ORF identifier is also shown in the Sequence Listing under the corresponding SEQ ID NO.

Thus, for example, the designation "SP126" refers to both the nucleotide and amino acid sequences of *S. pneumoniae* polypeptide number 126 of the present invention. Further, "SP126" correlates with the nucleotide sequence shown as SEQ ID NO:223 and with the amino acid sequence shown as SEQ ID NO:224 as is described in Table 1.

The open reading frame within each "ORF" begins with the second nucleotide shown. Thus, the first codon for each nucleotide sequence shown is bases 2–4, the second 5–7, the third 8–10, and so on.

Explanation of Table 2

Table 2 lists the antigenic epitopes present in each of the *S. pneumoniae* polypeptides described in Table 1 as predicted by the inventors. Each *S. pneumoniae* polypeptide shown in Table 1 has one or more antigenic epitopes described in Table 2. It will be appreciated that depending on the analytical criteria used to predict antigenic determinants, the exact address of the determinant may vary slightly. The exact location of the antigenic determinant may shift by about 1 to 5 residues, more likely 1 to 2 residues, depending on the criteria used. Thus, the first antigenic determinant described in Table 2, "Lys-1 to Ile-10" of SP001, represents a peptide comprising the lysine at position 1 in SEQ ID NO:2 through and including the isoleucine at position 10 in SEQ ID NO:2, but may include more or fewer residues than those 10. It will also be appreciated that, generally speaking, amino acids can be added to either terminus of a peptide or polypeptide containing an antigenic epitope without affecting its activity, whereas removing residues from a peptide or polypeptide containing only the antigenic determinant is much more likely to destroy activity. It will be appreciated that the residues and locations shown described in Table 2 correspond to the amino acid sequences for each ORF shown in Table 1 and in the Sequence Listing.

Explanation of Table 3

Table 3 shows PCR primers designed by the inventors for the amplification of polynucleotides encoding polypeptides of the present invention according to the method of Example 1. PCR primer design is routine in the art and those shown in Table 3 are provided merely for the convenience of the skilled artisan. It will be appreciated that others can be used with equal success.

For each primer, the table lists the corresponding ORF designation from Table 1 followed by either an "A" or a "B". The "A" primers are the 5' primers and the "B" primers 3'. A restriction enzyme site was built into each primer to allow ease of cloning. The restriction enzyme which will recognize and cleave a sequence within each primer is shown in Table 3, as well, under the heading "RE" for restriction enzyme. Finally the sequence identifier is shown in Table 3 for each primer for easy correlation with the Sequence Listing.

Selection of Nucleic Acid Sequences Encoding Antigenic *S. pneumoniae* Polypeptides The present invention provides a select number of ORFs from those presented in the fragments of the *S. pneumoniae* genome which may prove useful for the generation of a protective immune response. The sequenced *S. pneumoniae* genomic DNA was obtained from a sub-cultured isolate of *S. pneumoniae* Strain 7/87 14.8.91, which has been deposited at the American Type Culture Collection, as a convenience to those of skill in the art. The *S. pneumoniae* isolate was deposited on Oct. 10, 1996 at the ATCC, 12301 Park Lawn Drive, Rockville, Md. 20852, and given accession number 55840. A genomic library constructed from DNA isolated from the *S. pneumoniae* isolate was also deposited at the ATCC on Oct. 11, 1996 and given ATCC Deposit No. 97755. A more complete listing of the sequence obtained from the *S. pneumoniae* genome may be found in co-pending U.S. Provisional Application Ser. No. 60/029,960, filed Oct. 31, 1996, incorporated herein by reference in its entirety. Some ORFs contained in the subset of fragments of the *S. pneumoniae* genome disclosed herein were derived through the use of a number of screening criteria detailed below.

The selected ORFs do not consist of complete ORFs. Although a polypeptide representing a complete ORF may be the closest approximation of a protein native to an organism, it is not always preferred to express a complete ORF in a heterologous system. It may be challenging to express and purify a highly hydrophobic protein by common laboratory methods. Thus, the polypeptide vaccine candidates described herein may have been modified slightly to simplify the production of recombinant protein. For example, nucleotide sequences which encode highly hydrophobic domains, such as those found at the amino terminal signal sequence, have been excluded from some constructs used for in vitro expression of the polypeptides. Furthermore, any highly hydrophobic amino acid sequences occurring at the carboxy terminus have also been excluded from the recombinant expression constructs. Thus, in one embodiment, a polypeptide which represents a truncated or modified ORF may be used as an antigen.

While numerous methods are known in the art for selecting potentially immunogenic polypeptides, many of the ORFs disclosed herein were selected on the basis of screening all theoretical *S. pneumoniae* ORFs for several aspects of potential immunogenicity. One set of selection criteria are as follows:

1. Type I signal sequence: An amino terminal type I signal sequence generally directs a nascent protein across the plasma and outer membranes to the exterior of the bacterial cell. Experimental evidence obtained from studies with *Escherichia coli* suggests that the typical type I signal sequence consists of the following biochemical and physical attributes (Izard, J. W. and Kendall, D. A. *Mol. Microbiol.* 13:765–773 (1994)). The length of the type I signal sequence is approximately 15 to 25 primarily hydrophobic amino acid residues with a net positive charge in the extreme amino terminus. In addition, the central region of the signal sequence adopts an alpha-helical conformation in a hydrophobic environment. Finally, the region surrounding the actual site of cleavage is ideally six residues long, with small side-chain amino acids in the −1 and −3 positions.

2. Type IV signal sequence: The type IV signal sequence is an example of the several types of functional signal sequences which exist in addition to the type I signal sequence detailed above. Although functionally related, the type IV signal sequence possesses a unique set of biochemical and physical attributes (Strom, M. S. and Lory, S., *J. Bacteriol.* 174:7345–7351 (1992)). These are typically six to eight amino acids with a net basic charge followed by an additional sixteen to thirty primarily hydrophobic residues. The cleavage site of a type IV signal sequence is typically after the initial six to eight amino acids at the extreme amino terminus. In addition, type IV signal sequences generally contain a phenylalanine residue at the +1 site relative to the cleavage site.

3. Lipoprotein: Studies of the cleavage site of twenty-six bacterial lipoprotein precursors has allowed the definition of a consensus amino acid sequence for lipoprotein cleavage. Nearly three-fourths of the bacterial lipoprotein precursors examined contained the sequence L-(A,S)-(G,A)-C (SEQ ID NO:453) 41 positions −3 to +1 relative to the point of cleavage (Hayashi, S. and Wu. H. C., *J. Bioenerg. Bio member.* 22:451–471 (1990)).

4. LPXTG motif: It has been experimentally determined that most anchored proteins found on the surface of gram-positive bacteria possess a highly conserved carboxy terminal sequence. More than fifty such proteins from organisms such as *S. pyogenes. S. mutants, E. faecalis, S. pneumoniae*, and others, have been identified based on their extracellular location and carboxy terminal amino acids sequence (Fischerri, V. A., *ASM News* 62:405–410 (1996)). The conserved region consists of six charged amino acids at the extreme carboxy terminus coupled to 15–20 hydrophobic amino acids presumed to function as a transmembrane domain. Immediately adjacent to the transmembrane domain is a six amino acid sequence conserved in nearly all proteins examined. The amino acid sequence of this region is L-P-X-T-G-X (SEQ ID NO: 454) where X is any amino acid.

An algorithm for selecting antigenic and immunogenic *S. pneumoniae* polypeptides including the foregoing criteria was developed. Use of the algorithm by the inventors to select immunologically useful *S. pneumoniae* polypeptides resulted in the selection of a number of the disclosed —ORFs. Polypeptides comprising the polypeptides identified in this group may be produced by techniques standard in the art and as further described herein.

Nucleic Acid Molecules

The present invention provides isolated nucleic acid molecules comprising polynucleotides encoding the *S. pneumoniae* polypeptides having the amino acid sequences described in Table 1 and shown as SEQ ID NO:2, SEQ ID NO:4, SEQ ID NO:6, and so on through SEQ ID NO:226, which were determined by sequencing the genome of *S. pneumoniae* and selected as putative immunogens.

Unless otherwise indicated, all nucleotide sequences determined by sequencing a DNA molecule herein were determined using an automated DNA sequencer (such as the Model 373 from Applied Biosystems, Inc.), and all amino acid sequences of polypeptides encoded by DNA molecules determined herein were predicted by translation of DNA sequences determined as above. Therefore, as is known in the art for any DNA sequence determined by this automated approach, any nucleotide sequence determined herein may contain some errors. Nucleotide sequences determined by automation are typically at least about 90% identical, more typically at least about 95% to at least about 99.9% identical to the actual nucleotide sequence of the sequenced DNA molecule. The actual sequence can be more precisely determined by other approaches including manual DNA sequencing methods well known in the art.

As is also known in the art, a single insertion or deletion in a determined nucleotide sequence compared to the actual sequence will cause a frame shift in translation of the nucleotide sequence such that the predicted amino acid sequence encoded by a determined nucleotide sequence will be completely different from the amino acid sequence actually encoded by the sequenced DNA molecule, beginning at the point of such an insertion or deletion.

Unless otherwise indicated, each "nucleotide sequence" set forth herein is presented as a sequence of deoxyribonucleotides (abbreviated A, G, C and T). However, by "nucleotide sequence" of a nucleic acid molecule or polynucleotide is intended, for a DNA molecule or polynucleotide, a sequence of deoxyribonucleotides, and for an RNA molecule or polynucleotide, the corresponding sequence of ribonucleotides (A, G, C and U), where each thymidine deoxyribonucleotide (T) in the specified deoxyribonucleotide sequence is replaced by the ribonucleotide uridine (U). For instance, reference to an RNA molecule having a sequence described in Table 1 set forth using deoxyribonucleotide abbreviations is intended to indicate an RNA molecule having a sequence in which each deoxyribonucleotide A, G or C described in Table 1 has been replaced by the corresponding ribonucleotide A, G or C, and each deoxyribonucleotide T has been replaced by a ribonucleotide U.

Nucleic acid molecules of the present invention may be in the form of RNA, such as mRNA, or in the form of DNA, including, for instance, cDNA and genomic DNA obtained by cloning or produced synthetically. The DNA may be double-stranded or single-stranded. Single-stranded DNA or RNA may be the coding strand, also known as the sense strand, or it may be the non-coding strand, also referred to as the anti-sense strand.

By "isolated" nucleic acid molecule(s) is intended a nucleic acid molecule, DNA or RNA, which has been removed from its native environment. For example, recombinant DNA molecules contained in a vector are considered isolated for the purposes of the present invention. Further examples of isolated DNA molecules include recombinant DNA molecules maintained in heterologous host cells or purified (partially or substantially) DNA molecules in solution. Isolated RNA molecules include in vivo or in vitro RNA transcripts of the DNA molecules of the present invention. Isolated nucleic acid molecules according to the present invention further include such molecules produced synthetically.

Isolated nucleic acid molecules of the present invention include DNA molecules comprising a nucleotide sequence described in Table 1 and shown as SEQ ID NO:1, SEQ ID NO:3, SEQ ID NO:5, and so on through SEQ ID NO:225; DNA molecules comprising the coding sequences for the polypeptides described in Table 1 and shown as SEQ ID NO:2, SEQ ID NO:4, SEQ ID NO:6, and so on through SEQ ID NO:226; and DNA molecules which comprise sequences substantially different from those described above but which, due to the degeneracy of the genetic code, still encode the S. pneumoniae polypeptides described in Table 1. Of course, the genetic code is well known in the art. Thus, it would be routine for one skilled in the art to generate such degenerate variants.

The invention also provides nucleic acid molecules having sequences complementary to any one of those described in Table 1. Such isolated molecules, particularly DNA molecules, are useful as probes for detecting expression of Streptococcal genes, for instance, by Northern blot analysis or the polymerase chain reaction (PCR).

The present invention is further directed to fragments of the isolated nucleic acid molecules described herein. By a fragment of an isolated nucleic acid molecule having a nucleotide sequence described in Table 1, is intended fragments at least about 15 nt, and more preferably at least about 17 nt, still more preferably at least about 20 nt, and even more preferably, at least about 25 nt in length which are useful as diagnostic probes and primers as discussed herein.

Of course, larger fragments 50–100 nt in length are also useful according to the present invention as are fragments corresponding to most, if not all, of a nucleotide sequence described in Table 1. By a fragment at least 20 nt in length, for example, is intended fragments which include 20 or more contiguous bases of a nucleotide sequence as described in Table 1. Since the nucleotide sequences identified in Table 1 are provided as SEQ ID NO:1, SEQ ID NO:3, SEQ ID NO:5, and so on through SEQ ID NO:225, generating such DNA fragments would be routine to the skilled artisan. For example, such fragments could be generated synthetically.

Preferred nucleic acid fragments of the present invention also include nucleic acid molecules comprising nucleotide sequences encoding epitope-bearing portions of the S. pneumoniae polypeptides identified in Table 1. Such nucleic acid fragments of the present invention include, for example, nucleotide sequences encoding polypeptide fragments comprising from about the amino terminal residue to about the carboxy terminal residue of each fragment shown in Table 2. The above referred to polypeptide fragments are antigenic regions of the S. pneumoniae polypeptides identified in Table 1.

In another aspect, the invention provides isolated nucleic acid molecules comprising polynucleotides which hybridize under stringent hybridization conditions to a portion of a polynucleotide in a nucleic acid molecule of the invention described above, for instance, a nucleic acid sequence identified in Table 1. By "stringent hybridization conditions" is intended overnight incubation at 42° C. in a solution comprising: 50% formamide, 5×SSC (150 nM NaCl, 15 mM trisodium citrate), 50 mM sodium phosphate (pH 7.6), 5×Denhardt's solution, 10% dextran sulfate, and 20 g/ml denatured, sheared salmon sperm DNA, followed by washing the filters in 0.1×SSC at about 65° C.

By polynucleotides which hybridize to a "portion" of a polynucleotide is intended polynucleotides (either DNA or RNA) which hybridize to at least about 15 nucleotides (nt), and more preferably at least about 17 nt, still more preferably at least about 20 nt, and even more preferably about 25–70 nt of the reference polynucleotide. These are useful as diagnostic probes and primers as discussed above and in more detail below.

Of course, polynucleotides hybridizing to a larger portion of the reference polynucleotide, for instance, a portion 50–100 nt in length, or even to the entire length of the reference polynucleotide, are also useful as probes according to the present invention, as are polynucleotides corresponding to most, if not all, of a nucleotide sequence as identified in Table 1. By a portion of a polynucleotide of "at least 20 nt in length," for example, is intended 20 or more contiguous nucleotides from the nucleotide sequence of the reference polynucleotide (e.g., a nucleotide sequences as described in Table 1). As noted above, such portions are useful diagnostically either as probes according to conventional DNA hybridization techniques or as primers for amplification of a target sequence by PCR, as described in the literature (for instance, in *Molecular Cloning, A Laboratory Manual*, 2nd. edition, Sambrook, J., Fritsch, E. F. and Maniatis, T., eds., Cold Spring Harbor Laboratory Press, Cold Spring Harbor, N.Y. (1989), the entire disclosure of which is hereby incorporated herein by reference).

Since nucleic acid sequences encoding the S. pneumoniae polypeptides of the present invention are identified in Table 1 and provided as SEQ ID NO:1, SEQ ID NO:3, SEQ ID NO:5, and so on through SEQ ID NO:225, generating polynucleotides which hybridize to portions of these sequences would be routine to the skilled artisan. For example, the hybridizing polynucleotides of the present invention could be generated synthetically according to known techniques.

As indicated, nucleic acid molecules of the present invention which encode S. pneumoniae polypeptides of the present invention may include, but are not limited to those encoding the amino acid sequences of the polypeptides by themselves; and additional coding sequences which code for additional amino acids, such as those which provide additional functionalities. Thus, the sequences encoding these polypeptides may be fused to a marker sequence, such as a sequence encoding a peptide which facilitates purification of the fused polypeptide. In certain preferred embodiments of this aspect of the invention, the marker amino acid sequence is a hexa-histidine peptide, such as the tag provided in a pQE vector (Qiagen, Inc.), among others, many of which are commercially available. As described by Gentz and colleagues (*Proc. Natl. Acad. Sci. USA* 86:821–824 (1989)), for instance, hexa-histidine provides for convenient purification of the resulting fusion protein.

Thus, the present invention also includes genetic fusions wherein the S. pneumoniae nucleic acid sequences coding sequences identified in Table 1 are linked to additional nucleic acid sequences to produce fusion proteins. These fusion proteins may include epitopes of streptococcal or non-streptococcal origin designed to produce proteins having enhanced immunogenicity. Further, the fusion proteins of the present invention may contain antigenic determinants known to provide helper T-cell stimulation, peptides encoding sites for post-translational modifications which enhance immunogenicity (e.g., acylation), peptides which facilitate purification (e.g., histidine "tag"), or amino acid sequences which target the fusion protein to a desired location (e.g., a heterologous leader sequence).

In all cases of bacterial expression, an N-terminal methionine residues is added. In many cases, however, the N-terminal methionine residues is cleaved off post-translationally. Thus, the invention includes polypeptides shown in Table 1 with, and without an N-terminal methionine.

The present invention thus includes nucleic acid molecules and sequences which encode fusion proteins comprising one or more S. pneumoniae polypeptides of the present invention fused to an amino acid sequence which allows for post-translational modification to enhance immunogenicity. This post-translational modification may occur either in vitro or when the fusion protein is expressed in vivo in a host cell. An example of such a modification is the introduction of an amino acid sequence which results in the attachment of a lipid moiety.

Thus, as indicated above, the present invention includes genetic fusions wherein a S. pneumoniae nucleic acid sequence identified in Table 1 is linked to a nucleotide sequence encoding another amino acid sequence. These other amino acid sequences may be of streptococcal origin (e.g., another sequence selected from Table 1) or non-streptococcal origin.

The present invention further relates to variants of the nucleic acid molecules of the present invention, which encode portions, analogs or derivatives of the S. pneumoniae polypeptides described in Table 1. Variants may occur naturally, such as a natural allelic variant. By an "allelic variant" is intended one of several alternate forms of a gene occupying a given locus on a chromosome of an organism (*Genes II*, Lewin, B., ed., John Wiley & Sons, New York (1985)). Non-naturally occurring variants may be produced using art-known mutagenesis techniques.

Such variants include those produced by nucleotide substitutions, deletions or additions. The substitutions, deletions or additions may involve one or more nucleotides. These variants may be altered in coding regions, non-coding regions, or both. Alterations in the coding regions may produce conservative or non-conservative amino acid substitutions, deletions or additions. Especially preferred among these are silent substitutions, additions and deletions, which do not alter the properties and activities of the S. pneumoniae polypeptides disclosed herein or portions thereof. Silent substitution are most likely to be made in non-epitopic regions. Guidance regarding those regions containing epitopes is provided herein, for example, in Table 2. Also especially preferred in this regard are conservative substitutions.

Further embodiments of the invention include isolated nucleic acid molecules comprising a polynucleotide having a nucleotide sequence at least 90% identical, and more preferably at least 95%, 96%, 97%, 98% or 99% identical to: (a) a nucleotide sequence encoding any of the amino acid sequences of the polypeptides identified in Table 1; and (b) a nucleotide sequence complementary to any of the nucleotide sequences in (a) above.

By a polynucleotide having a nucleotide sequence at least, for example, 95% "identical" to a reference nucleotide sequence encoding a S. pneumoniae polypeptide described in Table 1, is intended that the nucleotide sequence of the polynucleotide is identical to the reference sequence except that the polynucleotide sequence may include up to five point mutations per each 100 nucleotides of the reference nucleotide sequence encoding the subject S. pneumoniae polypeptide. In other words, to obtain a polynucleotide having a nucleotide sequence at least 95% identical to a reference nucleotide sequence, up to 5% of the nucleotides in the reference sequence may be deleted or substituted with another nucleotide, or a number of nucleotides up to 5% of the total nucleotides in the reference sequence may be inserted into the reference sequence. These mutations of the reference sequence may occur at the 5' or 3' terminal positions of the reference nucleotide sequence or anywhere between those terminal positions, interspersed either individually among nucleotides in the reference sequence or in one or more contiguous groups within the reference sequence.

Certain nucleotides within some of the nucleic acid sequences shown in Table 1 were ambiguous upon sequencing. Completely unknown sequences are shown as an "N". Other unresolved nucleotides are known to be either a purine, shown as "R", or a pyrimidine, shown as "Y". Accordingly, when determining identity between two nucleotide sequences, identity is met where any nucleotide, including an "R", "Y" or "N", is found in a test sequence and at the corresponding position in the reference sequence (from Table 1). Likewise, an A, G or "R" in a test sequence is identical to an "R" in the reference sequence; and a T, C or "Y" in a test sequence is identical to a "Y" in the reference sequence.

As a practical matter, whether any particular nucleic acid molecule is at least 90%, 95%, 96%, 97%, 98% or 99% identical to, for instance, a nucleotide sequence described in Table 1 can be determined conventionally using known computer programs such as the Bestfit program (Wisconsin Sequence Analysis Package, Version 8 for Unix, Genetics Computer Group, University Research Park, 575 Science Drive, Madison, Wis. 53711). Bestfit uses the local homology algorithm of Smith and Waterman (Advances in *Applied Mathematics* 2:482–489 (1981)), to find the best segment of homology between two sequences. When using Bestfit or any other sequence alignment program to determine whether a particular sequence is, for instance, 95% identical to a reference sequence according to the present invention, the parameters are set, of course, such that the percentage of identity is calculated over the full length of the reference nucleotide sequence and that gaps in homology of up to 5% of the total number of nucleotides in the reference sequence are allowed.

The present application is directed to nucleic acid molecules at least 90%, 95%, 96%, 97%, 98% or 99% identical to a nucleic acid sequences described in Table 1. One of skill in the art would still know how to use the nucleic acid molecule, for instance, as a hybridization probe or a polymerase chain reaction (PCR) primer. Uses of the nucleic acid molecules of the present invention include, inter alia, (1) isolating *Streptococcal* genes or allelic variants thereof from either a genomic or cDNA library and (2) Northern Blot or PCR analysis for detecting *Streptococcal* mRNA expression.

Of course, due to the degeneracy of the genetic code, one of ordinary skill in the art will immediately recognize that a large number of nucleic acid molecules having a sequence at least 90%, 95%, 96%, 97%, 98%, or 99% identical to a nucleic acid sequence identified in Table 1 will encode the same polypeptide. In fact, since degenerate variants of these nucleotide sequences all encode the same polypeptide, this will be clear to the skilled artisan even without performing the above described comparison assay.

It will be further recognized in the art that, for such nucleic acid molecules that are not degenerate variants, a reasonable number will also encode proteins having antigenic epitopes of the *S. pneumoniae* polypeptides of the present invention. This is because the skilled artisan is fully aware of amino acid substitutions that are either less likely or not likely to significantly effect the antigenicity of a polypeptide (e.g., replacement of an amino acid in a region which is not believed to form an antigenic epitope). For example, since antigenic epitopes have been identified which contain as few as six amino acids (see Harlow, et al., *Antibodies: A Laboratory Manual,* 2nd Ed; Cold Spring Harbor Laboratory Press, Cold Spring Harbor, N.Y. (1988), page 76), in instances where a polypeptide has multiple antigenic epitopes the alteration of several amino acid residues would often not be expected to eliminate all of the antigenic epitopes of that polypeptide. This is especially so when the alterations are in regions believed to not constitute antigenic epitopes.

Vectors and Host Cells

The present invention also relates to vectors which include the isolated DNA molecules of the present invention, host cells which are genetically engineered with the recombinant vectors, and the production of *S. pneumoniae* polypeptides or fragments thereof by recombinant techniques.

Recombinant constructs may be introduced into host cells using well known techniques such as infection, transduction, transfection, transvection, electroporation and transformation. The vector may be, for example, a phage, plasmid, viral or retroviral vector. Retroviral vectors may be replication competent or replication defective. In the latter case, viral propagation generally will occur only in complementing host cells.

The polynucleotides may be joined to a vector containing a selectable marker for propagation in a host. Generally, a plasmid vector is introduced in a precipitate, such as a calcium phosphate precipitate, or in a complex with a charged lipid. If the vector is a virus, it may be packaged in vitro using an appropriate packaging cell line and then transduced into host cells.

Preferred are vectors comprising cis-acting control regions to the polynucleotide of interest. Appropriate trans-acting factors may be supplied by the host, supplied by a complementing vector or supplied by the vector itself upon introduction into the host.

In certain preferred embodiments in this regard, the vectors provide for specific expression, which may be inducible and/or cell type-specific. Particularly preferred among such vectors are those inducible by environmental factors that are easy to manipulate, such as temperature and nutrient additives.

Expression vectors useful in the present invention include chromosomal-, episomal- and virus-derived vectors, e.g., vectors derived from bacterial plasmids, bacteriophage, yeast episomes, yeast chromosomal elements, viruses such as baculoviruses, papova viruses, vaccinia viruses, adenoviruses, fowl pox viruses, pseudorabies viruses and retroviruses, and vectors derived from combinations thereof, such as cosmids and phagemids.

The DNA insert should be operatively linked to an appropriate promoter, such as the phage lambda PL promoter, the *E. coli* Lac, trp and tac promoters, the SV40 early and late promoters and promoters of retroviral LTRs, to name a few. Other suitable promoters will be known to the skilled artisan. The expression constructs will further contain sites for transcription initiation, termination and, in the transcribed region, a ribosome binding site for translation. The coding portion of the mature transcripts expressed by the constructs will preferably include a translation initiating site at the beginning and a termination codon (UAA, UGA or UAG) appropriately positioned at the end of the polypeptide to be translated.

As indicated, the expression vectors will preferably include at least one selectable marker. Such markers include dihydrofolate reductase or neomycin resistance for eukaryotic cell culture and tetracycline or ampicillin resistance genes for culturing in *E. coli* and other bacteria Representative examples of appropriate hosts include, but are not limited to, bacterial cells, such as *E. coli, Streptomyces* and *Salmonella typhimurium* cells; fungal cells, such as yeast cells; insect cells such as *Drosophila* S2 and *Spodoptera* Sf9 cells; animal cells such as CHO, COS and Bowes melanoma cells; and plant cells. Appropriate culture mediums and conditions for the above-described host cells are known in the art.

Among vectors preferred for use in bacteria include pQE70, pQE60 and pQE-9, available from Qiagen; pBS vectors, Phagescript vectors, Bluescript vectors, pNH8A, pNH16a, pNH18A, pNH46A available from Stratagene; pET series of vectors available from Novagen; and ptrc99a, pKK223-3, pKK233-3, pDR540, pRIT5 available from Pharmacia Among preferred eukaryotic vectors are pWLNEO, pSV2CAT, pOG44, pXT1 and pSG available from Stratagene; and pSVK3, pBPV, pMSG and PSVL available from Pharmacia. Other suitable vectors will be readily apparent to the skilled artisan.

Among known bacterial promoters suitable for use in the present invention include the *E. coli* lacI and lacZ promoters, the T3 and T7 promoters, the gpt promoter, the lambda PR and PL promoters and the trp promoter. Suitable eukaryotic promoters include the CMV immediate early promoter, the HSV thymidine kinase promoter, the early and late SV40 promoters, the promoters of retroviral LTRs, such as those of the Rous sarcoma virus (RSV), and metallothionein promoters, such as the mouse metallothionein-I promoter.

Introduction of the construct into the host cell can be effected by calcium phosphate transfection, DEAE-dextran mediated transfection, cationic lipid-mediated transfection, electroporation, transduction, infection or other methods. Such methods are described in many standard laboratory manuals (for example, Davis, et al., *Basic Methods In Molecular Biology* (1986)).

Transcription of DNA encoding the polypeptides of the present invention by higher eukaryotes may be increased by inserting an enhancer sequence into the vector. Enhancers are cis-acting elements of DNA, usually about from 10 to 300 bp that act to increase transcriptional activity of a promoter in a given host cell-type. Examples of enhancers include the SV40 enhancer, which is located on the late side of the replication origin at bp 100 to 270, the cytomegalovirus early promoter enhancer, the polyoma enhancer on the late side of the replication origin, and adenovirus enhancers.

For secretion of the translated polypeptide into the lumen of the endoplasmic reticulum, into the periplasmic space or into the extracellular environment, appropriate secretion signals may be incorporated into the expressed polypeptide. The signals may be endogenous to the polypeptide or they may be heterologous signals.

The polypeptide may be expressed in a modified form, such as a fusion protein, and may include not only secretion signals, but also additional heterologous functional regions. For instance, a region of additional amino acids, particularly charged amino acids, may be added to the N-terminus of the polypeptide to improve stability and persistence in the host cell, during purification, or during subsequent handling and storage. Also, peptide moieties may be added to the polypeptide to facilitate purification. Such regions may be removed prior to final preparation of the polypeptide. The addition of peptide moieties to polypeptides to engender secretion or excretion, to improve stability and to facilitate purification, among others, are familiar and routine techniques in the art. A preferred fusion protein comprises a heterologous region from immunoglobulin that is useful to solubilize proteins. For example, EP-A-O 464 533 (Canadian counterpart 2045869) discloses fusion proteins comprising various portions of constant region of immunoglobin molecules together with another human protein or part thereof. In many cases, the Fc part in a fusion protein is thoroughly advantageous for use in-therapy-and diagnosis and thus results, for example, in improved pharmacokinetic properties (EP-A 0232 262).

On the other hand, for some uses it would be desirable to be able to delete the Fc part after the fusion protein has been expressed, detected and purified in the advantageous manner described. This is the case when Fc portion proves to be a hindrance to use in therapy and diagnosis, for example when the fusion protein is to be used as antigen for immunizations. In drug discovery, for example, human proteins, such as, hIL5-receptor has been fused with Fc portions for the purpose of high-throughput screening assays to identify antagonists of hIL-5. See Bennett, D. et al., *J. Molec. Recogn.* 8:52–58 (1995) and Johanson, K. et al., *J. Biol. Chem.* 270 (16):9459–9471 (1995).

The *S. pneumoniae* polypeptides can be recovered and purified from recombinant cell cultures by well-known methods including ammonium sulfate or ethanol precipitation, acid extraction, anion or cation exchange chromatography, phosphocellulose chromatography, hydrophobic interaction chromatography, affinity chromatography, hydroxylapatite chromatography, lectin chromatography and high performance liquid chromatography ("HPLC") is employed for purification. Polypeptides of the present invention include naturally purified products, products of chemical synthetic procedures, and products produced by recombinant techniques from a prokaryotic or eukaryotic host, including, for example, bacterial, yeast, higher plant, insect and mammalian cells.

Polypeptides and Fragments

The invention further provides isolated polypeptides having the amino acid sequences described in Table 1, and shown as SEQ ID NO:2, SEQ ID NO:4, SEQ ID NO:6, and so on through SEQ ID NO:226, and peptides or polypeptides comprising portions of the above polypeptides. The terms "peptide" and "oligopeptide" are considered synonymous (as is commonly recognized) and each term can be used interchangeably as the context requires to indicate a chain of at least two amino acids coupled by peptidyl linkages. The word "polypeptide" is used herein for chains containing more than ten amino acid residues. All oligopeptide and polypeptide formulas or sequences herein are written from left to right and in the direction from amino terminus to carboxy terminus.

Some amino acid sequences of the *S. pneumoniae* polypeptides described in Table 1 can be varied without significantly effecting the antigenicity of the polypeptides. If such differences in sequence are contemplated, it should be remembered that there will be critical areas on the polypeptide which determine antigenicity. In general, it is possible to replace residues which do not form part of an antigenic epitope without significantly effecting the antigenicity of a polypeptide. Guidance for such alterations is given in Table 2 wherein epitopes for each polypeptide is delineated.

The polypeptides of the present invention are preferably provided in an isolated form. By "isolated polypeptide" is intended a polypeptide removed from its native environment. Thus, a polypeptide produced and/or contained within a recombinant host cell is considered isolated for purposes of the present invention. Also intended as an "isolated polypeptide" is a polypeptide that has been purified, partially or substantially, from a recombinant host cell. For example, recombinantly produced versions of the *S. pneumoniae* polypeptides described in Table 1 can be substantially purified by the one-step method described by Smith and Johnson (*Gene* 67:31–40 (1988)).

The polypeptides of the present invention include: (a) an amino acid sequence of any of the polypeptides described in Table 1; and (b) an amino acid sequence of an epitope-bearing portion of any one of the polypeptides of (a); as well as polypeptides with at least 70% similarity, and more preferably at least 75%, 80%, 85%, 90%, 95%, 96%, 97%, 98%, or 99% similarity to those described in (a) or (b) above, as well as polypeptides having an amino acid sequence at least 70% identical, more preferably at least 75% identical, and still more preferably 80%, 85%, 90%, 95%, 96%, 97%, 98%, or 99% identical to those above.

By "% similarity" for two polypeptides is intended a similarity score produced by comparing the amino acid sequences of the two polypeptides using the Bestfit program (Wisconsin Sequence Analysis Package, Version 8 for Unix, Genetics Computer Group, University Research Park, 575 Science Drive, Madison, Wis. 53711) and the default settings for determining similarity. Bestfit uses the local homology algorithm of Smith and Waterman (*Advances in Applied Mathematics* 2:482–489 (1981)) to find the best segment of similarity between two sequences.

By a polypeptide having an amino acid sequence at least, for example, 95% "identical" to a reference amino acid sequence of a *S. pneumoniae* polypeptide is intended that the amino acid sequence of the polypeptide is identical to the reference sequence except that the polypeptide sequence may include up to five amino acid alterations per each 100 amino acids of the reference amino acid sequence. In other words, to obtain a polypeptide having an amino acid sequence at least 95% identical to a reference amino acid sequence, up to 5% of the amino acid residues in the reference sequence may be deleted or substituted with another amino acid, or a number of amino acids up to 5% of the total amino acid residues in the reference sequence may be inserted into the reference sequence. These alterations of the reference sequence may occur at the amino or carboxy terminal positions of the reference amino acid sequence or anywhere between those terminal positions, interspersed either individually among residues in the reference sequence or in one or more contiguous groups within the reference sequence.

The amino acid sequences shown in Table 1 may have on or more "X" residues. "X" represents unknown. Thus, for purposes of defining identity, if any amino acid is present at the same position in a reference amino acid sequence (shown in Table 1) where an X is shown, the two sequences are identical at that position.

As a practical matter, whether any particular polypeptide is at least 70%, 75%, 80%, 85%, 90%, 95%, 96%, 97%, 98%, or 99% identical to, for instance, an amino acid sequence shown in Table 1, can be determined conventionally using known computer programs such the Bestfit program (Wisconsin Sequence Analysis Package, Version 8 for Unix, Genetics Computer Group, University Research Park, 575 Science Drive, Madison, Wis. 53711). When using Bestfit or any other sequence alignment program to determine whether a particular sequence is, for instance, 95% identical to a reference sequence according to the present invention, the parameters are set, of course, such that the percentage of identity is calculated over the full length of the reference amino acid sequence and that gaps in homology of up to 5% of the total number of amino acid residues in the reference sequence are allowed.

As described below, the polypeptides of the present invention can also be used to raise polyclonal and monoclonal antibodies, which are useful in assays for detecting *Streptococcal* protein expression.

In another aspect, the invention provides peptides and polypeptides comprising epitope-bearing portions of the *S. pneumoniae* polypeptides of the invention. These epitopes are immunogenic or antigenic epitopes of the polypeptides of the invention. An "immunogenic epitope" is defined as a part of a protein that elicits an antibody response when the whole protein or polypeptide is the immunogen. These immunogenic epitopes are believed to be confined to a few loci on the molecule. On the other hand, a region of a protein molecule to which an antibody can bind is defined as an "antigenic determinant" or "antigenic epitope." The number of immunogenic epitopes of a protein generally is less than the number of antigenic epitopes (Geysen, et al., *Proc. Natl. Acad. Sci. USA* 81:3998–4002 (1983)). Predicted antigenic epitopes are shown in Table 2, below.

As to the selection of peptides or polypeptides bearing an antigenic epitope (i.e., that contain a region of a protein molecule to which an antibody can bind), it is well known in that art that relatively short synthetic peptides that mimic part of a protein sequence are routinely capable of eliciting an antiserum that reacts with the partially mimicked protein (for instance, Sutcliffe, J., et al., *Science* 219:660–666 (1983)). Peptides capable of eliciting protein-reactive sera are frequently represented in the primary sequence of a protein, can be characterized by a set of simple chemical rules, and are confined neither to immunodominant regions of intact proteins (i.e., immunogenic epitopes) nor to the amino or carboxyl terminals. Peptides that are extremely hydrophobic and those of six or fewer residues generally are ineffective at inducing antibodies that bind to the mimicked protein; longer, peptides, especially those containing proline residues, usually are effective (Sutcliffe, et al., supra, p. 661). For instance, 18 of 20 peptides designed according to these guidelines, containing 8–39 residues covering 75% of the sequence of the influenza virus hemagglutinin HA1 polypeptide chain, induced antibodies that reacted with the HA1 protein or intact virus; and 12/12 peptides from the MuLV polymerase and 18/18 from the rabies glycoprotein induced antibodies that precipitated the respective proteins.

Antigenic epitope-bearing peptides and polypeptides of the invention are therefore useful to raise antibodies, including monoclonal antibodies, that bind specifically to a polypeptide of the invention. Thus, a high proportion of hybridomas obtained by fusion of spleen cells from donors immunized with an antigen epitope-bearing peptide generally secrete antibody reactive with the native protein (Sutcliffe, et al., supra, p. 663). The antibodies raised by antigenic epitope-bearing peptides or polypeptides are useful to detect the mimicked protein, and antibodies to different peptides may be used for tracking the fate of various regions of a protein precursor which undergoes post-translational processing. The peptides and anti-peptide antibodies may be used in a variety of qualitative or quantitative assays for the mimicked protein, for instance in competition assays since it has been shown that even short peptides (e.g., about 9 amino acids) can bind and displace the larger peptides in immunoprecipitation assays (for instance, Wilson, et al., *Cell* 37:767–778 (1984) p. 777). The anti-peptide antibodies of the invention also are useful for purification of the mimicked protein, for instance, by adsorption chromatography using methods well known in the art.

Antigenic epitope-bearing peptides and polypeptides of the invention designed according to the above guidelines preferably contain a sequence of at least seven, more preferably at least nine and most preferably between about 15 to about 30 amino acids contained within the amino acid sequence of a polypeptide of the invention. However, peptides or polypeptides comprising a larger portion of an amino acid sequence of a polypeptide of the invention, containing about 30 to about 50 amino acids, or any length up to and including the entire amino acid sequence of a polypeptide of the invention, also are considered epitope-bearing peptides or polypeptides of the invention and also are useful for inducing antibodies that react with the mimicked protein. Preferably, the amino acid sequence of the epitope-bearing peptide is selected to to provide substantial solubility in aqueous solvents (i.e., the sequence includes relatively hydrophilic residues and highly hydrophobic sequences are preferably avoided); and sequences containing proline residues are particularly preferred.

Non-limiting examples of antigenic polypeptides or peptides that can be used to generate *Streptococcal*-specific antibodies include portions of the amino acid sequences identified in Table 1. More specifically, Table 2 discloses antigenic fragments of polypeptides of the present invention, which antigenic fragments comprise amino acid sequences from about the first amino acid residues indicated to about the last amino acid residue indicated for each fragment. The polypeptide fragments disclosed in Table 2 are believed to be antigenic regions of the *S. pneumoniae* polypeptides described in Table 1. Thus the invention further includes isolated peptides and polypeptides comprising an amino acid sequence of an epitope shown in Table 2 and polynucleotides encoding said polypeptides.

The epitope-bearing peptides and polypeptides of the invention may be produced by any conventional means for making peptides or polypeptides including recombinant means using nucleic acid molecules of the invention. For instance, an epitope-bearing amino acid sequence of the present invention may be fused to a larger polypeptide which acts as a carrier during recombinant production and purification, as well as during immunization to produce anti-peptide antibodies. Epitope-bearing peptides also may be synthesized using known methods of chemical synthesis. For instance, Houghten has described a simple method for synthesis of large numbers of peptides, such as 10–20 mg of 248 different 13 residue peptides representing single amino acid variants of a segment of the HA1 polypeptide which were prepared and characterized (by ELISA-type binding studies) in less than four weeks (Houghten, R. A. Proc. Natl. Acad. Sci. USA 82:5131–5135 (1985)). This "Simultaneous Multiple Peptide Synthesis (SMPS)" process is further described in U.S. Pat. No. 4,631,211 to Houghten and coworkers (1986). In this procedure the individual resins for the solid-phase synthesis of various peptides are contained in separate solvent-permeable packets, enabling the optimal use of the many identical repetitive steps involved in solid-phase methods. A completely manual procedure allows 500–1000 or more syntheses to be conducted simultaneously (Houghten, et al., supra, p. 5134).

Epitope-bearing peptides and polypeptides of the invention are used to induce antibodies according to methods well known in the art (for instance, Sutcliffe, et al., supra; Wilson, et al., supra; Chow, M., er al., *Proc. Natl. Acad. Sci. USA* 82:910–914; and Bittle, F. J., et al., *J. Gen. Virol.* 66:2347–2354 (1985)). Generally, animals may be immunized with free peptide; however, anti-peptide antibody titer may be boosted by coupling of the peptide to a macromolecular carrier, such as keyhole limpet hemacyanin (KLH) or tetanus toxoid. For instance, peptides containing cysteine may be coupled to carrier using a linker such as m-maleimidobenzoyl-N-hydroxysuccinimide ester (MBS), while other peptides may be coupled to carrier using a more general linking agent such as glutaraldehyde. Animals such as rabbits, rats and mice are immunized with either free or carrier-coupled peptides, for instance, by intraperitoneal and/or intradermal injection of emulsions containing about 100 μg peptide or carrier protein and Freund's adjuvant. Several booster injections may be needed, for instance, at intervals of about two weeks, to provide a useful titer of anti-peptide antibody which can be detected, for example, by ELISA assay using free peptide adsorbed to a solid surface. The titer of anti-peptide antibodies in serum from an immunized animal may be increased by selection of anti-peptide antibodies, for instance, by adsorption to the peptide on a solid support and elution of the selected antibodies according to methods well known in the art.

Immunogenic epitope-bearing peptides of the invention, i.e., those parts of a protein that elicit an antibody response when the whole protein is the immunogen, are identified according to methods known in the art. For instance, Geysen, et al., supra, discloses a procedure for rapid concurrent synthesis on solid supports of hundreds of peptides of sufficient purity to react in an enzyme-linked immunosorbent assay. Interaction of synthesized peptides with antibodies is then easily detected without removing them from the support. In this manner a peptide bearing an immunogenic epitope of a desired protein may be identified routinely by one of ordinary skill in the art. For instance, the immunologically important epitope in the coat protein of foot-and-mouth disease virus was located by Geysen et al. supra with a resolution of seven amino acids by synthesis of an overlapping set of all 208 possible hexapeptides covering the entire 213 amino acid sequence of the protein. Then, a complete replacement set of peptides in which all 20 amino acids were substituted in turn at every position within the epitope were synthesized, and the particular amino acids conferring specificity for the reaction with antibody were determined. Thus, peptide analogs of the epitope-bearing peptides of the invention can be made routinely by this method. U.S. Pat. No. 4,708,781 to Geysen (1987) further describes this method of identifying a peptide bearing an immunogenic epitope of a desired protein.

Further still, U.S. Pat. No. 5,194,392, to Geysen (1990), describes a general method of detecting or determining the sequence of monomers (amino acids or other compounds) which is a topological equivalent of the epitope (i.e., a "mimotope") which is complementary to a particular paratope (antigen binding site) of an antibody of interest. More generally, U.S. Pat. No. 4,433,092, also to Geysen (1989), describes a method of detecting or determining a sequence of monomers which is a topographical equivalent of a ligand which is complementary to the ligand binding site of a particular receptor of interest. Similarly, U.S. Pat. No. 5,480,971 to Houghten, R. A. et al. (1996) discloses linear $C_1$–$C_7$-alkyl peralkylated oligopeptides and sets and libraries of such peptides, as well as methods for using such oligopeptide sets and libraries for determining the sequence of a peralkylated oligopeptide that preferentially binds to an acceptor molecule of interest. Thus, non-peptide analogs of the epitope-bearing peptides of the invention also can be made routinely by these methods.

The entire disclosure of each document cited in this section on "Polypeptides and Fragments" is hereby incorporated herein by reference.

As one of skill in the art will appreciate, the polypeptides of the present invention and the epitope-bearing fragments thereof described above can be combined with parts of the constant domain of immunoglobulins (IgG), resulting in chimeric polypeptides. These fusion proteins facilitate purification and show an increased half-life in vivo. This has been shown, e.g., for chimeric proteins consisting of the first two domains of the human CD4-polypeptide and various domains of the constant regions of the heavy or light chains of mammalian immunoglobulins (EPA 0,394,827; Traunecker et al, *Nature* 331:84–86 (1988)). Fusion proteins that have a disulfide-linked dimeric structure due to the IgG part can also be more efficient in binding and neutralizing other molecules than a monomeric *S. pneumoniae* polypeptide or fragment thereof alone (Fountoulakis et al., *J. Biochem.* 270:3958–3964 (1995)).

Diagnostic Assays

The present invention further relates to a method for assaying for *Streptococcal* infection in an animal via detecting the expression of genes encoding *Streptococcal* polypeptides (e.g., the polypeptides described Table 1). This method comprises analyzing tissue or body fluid from the animal for *Streptococcus*-specific antibodies or Streptococcal nucleic acids or proteins. Analysis of nucleic acid specific to *Streptococcus* can be done by PCR or hybridization techniques using nucleic acid sequences of the present invention as either hybridization probes or primers (cf. *Molecular Cloning: A Laboratory Manual, second edition*, edited by Sambrook, Fritsch, & Maniatis, Cold Spring Harbor Laboratory, 1989; Eremeeva et al., *J. Clin. Microbiol.* 32:803–810 (1994) which describes differentiation among spotted fever group *Ricketsiae* species by analysis of restriction fragment length polymorphism of PCR-amplified DNA). Methods for detecting *B. burgdorferi* nucleic acids via PCR are described, for example, in Chen et al., *J. Clin. Microbiol.* 32:589–595 (1994).

Where diagnosis of a disease state related to infection with *Streptococcus* has already been made, the present invention is useful for monitoring progression or regression of the disease state whereby patients exhibiting enhanced *Streptococcus* gene expression will experience a worse clinical outcome relative to patients expressing these gene(s) at a lower level.

By "assaying for *Streptococcal* infection in an animal via detection of genes encoding Streptococcal polypeptides" is intended qualitatively or quantitatively measuring or estimating the level of one or more *Streptococcus* polypeptides or the level of nucleic acid encoding *Streptococcus* polypeptides in a first biological sample either directly (e.g., by determining or estimating absolute protein level or nucleic level) or relatively (e.g., by comparing to the *Streptococcus* polypeptide level or mRNA level in a second biological sample). The *Streptococcus* polypeptide level or nucleic acid level in the second sample used for a relative comparison may be undetectable if obtained from an animal which is not infected with *Streptococcus*. When monitoring the progression or regression of a disease state, the *Streptococcus* polypeptide level or nucleic acid level may be compared to a second sample obtained from either an animal infected with *Streptococcus* or the same animal from which the first sample was obtained but taken from that animal at a different time than the first. As will be appreciated in the art, once a standard *Streptococcus* polypeptide level or nucleic acid level which corresponds to a particular stage of a *Streptococcus* infection is known, it can be used repeatedly as a standard for comparison.

By "biological sample" is intended any biological sample obtained from an animal, cell line, tissue culture, or other source which contains *Streptococcus* polypeptide, mRNA, or DNA. Biological samples include body fluids (such as plasma and synovial fluid) which contain *Streptococcus* polypeptides, and muscle, skin, and cartilage tissues. Methods for obtaining tissue biopsies and body fluids are well known in the art.

The present invention is useful for detecting diseases related to *Streptococcus* infections in animals. Preferred animals include monkeys, apes, cats, dogs, cows, pigs, mice, horses, rabbits and humans. Particularly preferred are humans.

Total RNA can be isolated from a biological sample using any suitable technique such as the single-step guanidinium-thiocyanate-phenol-chloroform method described in Chomczynski and Sacchi, *Anal. Biochem.* 162:156–159 (1987). mRNA encoding *Streptococcus* polypeptides having sufficient homology to the nucleic acid sequences identified in Table 1 to allow for hybridization between complementary sequences are then assayed using any appropriate method. These include Northern blot analysis, S1 nuclease mapping, the polymerase chain reaction (PCR), reverse transcription in combination with the polymerase chain reaction (RT-PCR), and reverse transcription in combination with the ligase chain reaction (RT-LCR).

Northern blot analysis can be performed as described in Harada et al., *Cell* 63:303–312 (1990). Briefly, total RNA is prepared from a biological sample as described above. For the Northern blot, the RNA is denatured in an appropriate buffer (such as glyoxal/dimethyl sulfoxide/sodium phosphate buffer), subjected to agarose gel electrophoresis, and transferred onto a nitrocellulose filter. After the RNAs have been linked to the filter by a UV linker, the filter is prehybridized in a solution containing formamide, SSC, Denhardt's solution, denatured salmon sperm, SDS, and sodium phosphate buffer. A *S. pneumoniae* polypeptide DNA sequence shown in Table 1 labeled according to any appropriate method (such as the $^{32}$P-multiprimed DNA labeling system (Amersham)) is used as probe. After hybridization overnight, the filter is washed and exposed to x-ray film. DNA for use as probe according to the present invention is described in the sections above and will preferably at least 15 bp in length.

S1 mapping can be performed as described in Fujita et al., *Cell* 49:357–367 (1987). To prepare probe DNA for use in S1 mapping, the sense strand of an above-described *S. pneumoniae* DNA sequence of the present invention is used as a template to synthesize labeled antisense DNA. The antisense DNA can then be digested using an appropriate restriction endonuclease to generate further DNA probes of a desired length. Such antisense probes are useful for visualizing protected bands corresponding to the target mRNA (i.e., mRNA encoding *Streptococcus* polypeptides).

Preferably, levels of mRNA encoding *Streptococcus* polypeptides are assayed using the RT-PCR method described in Makino et al., *Technique* 2:295–301 (1990). By this method, the radioactivities of the "amplicons" in the polyacrylamide gel bands are linearly related to the initial concentration of the target mRNA. Briefly, this method involves adding total RNA isolated from a biological sample in a reaction mixture containing a RT primer and appropriate buffer. After incubating for primer annealing, the mixture can be supplemented with a RT buffer, dNTPs, DTT, RNase inhibitor and reverse transcriptase. After incubation to achieve reverse transcription of the RNA, the RT products are then subject to PCR using labeled primers. Alternatively, rather than labeling the primers, a labeled dNTP can be included in the PCR reaction mixture. PCR amplification can be performed in a DNA thermal cycler according to conventional techniques. After a suitable number of rounds to achieve amplification, the PCR reaction mixture is electrophoresed on a polyacrylamide gel. After drying the gel, the radioactivity of the appropriate bands (corresponding to the mRNA encoding the *Streptococcus* polypeptides)) is quantified using an imaging analyzer. RT and PCR reaction ingredients and conditions, reagent and gel concentrations, and labeling methods are well known in the art. Variations on the RT-PCR method will be apparent to the skilled artisan.

Assaying *Streptococcus* polypeptide levels in a biological sample can occur using any art-known method. Preferred for assaying *Streptococcus* polypeptide levels in a biological sample are antibody-based techniques. For example, *Streptococcus* polypeptide expression in tissues can be studied with classical immunohistological methods. In these, the specific recognition is provided by the primary antibody (polyclonal or monoclonal) but the secondary detection system can utilize fluorescent, enzyme, or other conjugated secondary antibodies. As a result, an immunohistological staining of tissue section for pathological examination is obtained. Tissues can also be extracted, e.g., with urea and neutral detergent, for the liberation of *Streptococcus* polypeptides for Western-blot or dot/slot assay (Jalkanen, M., et al., *J. Cell. Biol.* 101:976–985 (1985); Jalkanen, M., et al., *J. Cell. Biol.* 105:3087–3096 (1987)). In this technique, which is based on the use of cationic solid phases, quantitation of a *Streptococcus* polypeptide can be accomplished using an isolated *Streptococcus* polypeptide as a standard. This technique can also be applied to body fluids.

Other antibody-based methods useful for detecting *Streptococcus* polypeptide gene expression include immunoassays, such as the enzyme linked immunosorbent assay (ELISA) and the radioimmunoassay (RIA). For example, a *Streptococcus* polypeptide-specific monoclonal antibodies can be used both as an immunoabsorbent and as an enzyme-labeled probe to detect and quantify a *Streptococcus* polypeptide. The amount of a *Streptococcus* polypeptide present in the sample can be calculated by reference to the amount present in a standard preparation using a linear regression computer algorithm.

Such an ELISA for detecting a tumor antigen is described in Iacobelli et al., *Breast Cancer Research and Treatment* 11:19–30 (1988). In another ELISA assay, two distinct specific monoclonal antibodies can be used to detect *Streptococcus* polypeptides in a body fluid. In this assay, one of the antibodies is used as the immunoabsorbent and the other as the enzyme-labeled probe.

The above techniques may be conducted essentially as a "one-step" or "two-step" assay. The "one-step" assay involves contacting the *Streptococcus* polypeptide with immobilized antibody and, without washing, contacting the mixture with the labeled antibody. The "two-step" assay involves washing before contacting the mixture with the labeled antibody. Other conventional methods may also be employed as suitable. It is usually desirable to immobilize one component of the assay system on a support, thereby allowing other components of the system to be brought into contact with the component and readily removed from the sample.

*Streptococcus* polypeptide-specific antibodies for use in the present invention can be raised against an intact *S. pneumonize* polypeptide of the present invention or fragment thereof. These polypeptides and fragments may be administered to an animal (e.g., rabbit or mouse) either with a carrier protein (e.g., albumin) or, if long enough (e.g., at least about 25 amino acids), without a carrier.

As used herein, the term "antibody" (Ab) or "monoclonal antibody" (Mab) is meant to include intact molecules as well as antibody fragments (such as, for example, Fab and F(ab')$_2$ fragments) which are capable of specifically binding to a *Streptococcus* polypeptide. Fab and F(ab')$_2$ fragments lack the Fc fragment of intact antibody, clear more rapidly from the circulation, and may have less non-specific tissue binding of an intact antibody (Wahl et al., *J. Nucl. Med.* 24:316–325 (1983)). Thus, these fragments are preferred.

The antibodies of the present invention may be prepared by any of a variety of methods. For example, the *S. pneumoniae* polypeptides identified in Table 1, or fragments thereof, can be administered to an animal in order to induce the production of sera containing polyclonal antibodies. In a preferred method, a preparation of a *S. pneumoniae* polypeptide of the present invention is prepared and purified to render it substantially free of natural contaminants. Such a preparation is then introduced into an animal in order to produce polyclonal antisera of high specific activity.

In the most preferred method, the antibodies of the present invention are monoclonal antibodies. Such monoclonal antibodies can be prepared using hybridoma technology (Kohler et al., *Nature* 256:495 (1975); Kohler et al., Eur. *J. Immunol.* 6:511 (1976); Kohler et al., Eur. *J. Immunol.* 6:292 (1976); Hammerling et al., In: *Monoclonal Antibodies and T-Cell Hybridomas*, Elsevier, N.Y., (1981) pp. 563–681). In general, such procedures involve immunizing an animal (preferably a mouse) with a *S. pneumoniae* polypeptide antigen of the present invention. Suitable cells can be recognized by their capacity to bind anti-*Streptococcus* polypeptide antibody. Such cells may be cultured in any suitable tissue culture medium; however, it is preferable to culture cells in Earle's modified Eagle's medium supplemented with 10% fetal bovine serum (inactivated at about 56° C.), and supplemented with about 10 g/l of nonessential amino acids, about 1,000 U/ml of penicillin, and about 100 µg/ml of streptomycin. The splenocytes of such mice are extracted and fused with a suitable myeloma cell line. Any suitable myeloma cell line may be employed in accordance with the present invention; however, it is preferable to employ the parent myeloma cell line (SP$_2$O), available from the American Type Culture Collection, Rockville, Md. After fusion, the resulting hybridoma cells are selectively maintained in HAT medium, and then cloned by limiting dilution as described by Wands et al. (*Gastroenterology* 80:225–232 (1981)). The hybridoma cells obtained through such a selection are then assayed to identify clones which secrete antibodies capable of binding the *Streptococcus* polypeptide antigen administered to immunized animal.

Alternatively, additional antibodies capable of binding to *Streptococcus* polypeptide antigens may be produced in a two-step procedure through the use of anti-idiotypic antibodies. Such a method makes use of the fact that antibodies are themselves antigens, and that, therefore, it is possible to obtain an antibody which binds to a second antibody. In accordance with this method, *Streptococcus* polypeptide-specific antibodies are used to immunize an animal, preferably a mouse. The splenocytes of such an animal are then used to produce hybridoma cells, and the hybridoma cells are screened to identify clones which produce an antibody whose ability to bind to the *Streptococcus* polypeptide-specific antibody can be blocked by a *Streptococcus* polypeptide antigen. Such antibodies comprise anti-idiotypic antibodies to the *Streptococcus* polypeptide-specific antibody and can be used to immunize an animal to induce formation of further *Streptococcus* polypeptide-specific antibodies.

It will be appreciated that Fab and F(ab')$_2$ and other fragments of the antibodies of the present invention may be used according to the methods disclosed herein. Such fragments are typically produced by proteolytic cleavage, using enzymes such as papain (to produce Fab fragments) or pepsin (to produce F(ab')$_2$ fragments). Alternatively, *Streptococcus* polypeptide-binding fragments can be produced through the application of recombinant DNA technology or through synthetic chemistry.

Of special interest to the present invention are antibodies to *Streptococcus* polypeptide antigens which are produced in humans, or are "humanized" (ie., non-immunogenic in a human) by recombinant or other technology. Humanized antibodies may be produced, for example by replacing an immunogenic portion of an antibody with a corresponding, but non-immunogenic portion (i.e., chimeric antibodies) (Robinson, R. R. et al., International Patent Publication PCT/US86/02269; Akira, K. et al., European Patent Application 184,187; Taniguchi, M., European Patent Application 171,496; Morrison, SL. et al., European Patent Application 173,494; Neuberger, M. S. et al., PCT Application WO 86/01533; Cabilly, S. et al., European Patent Application 125,023; Better, M. et al., *Science* 240:1041–1043 (1988); Liu, A. Y. et al., *Proc. Natl. Acad. Sci. USA* 84:3439–3443 (1987); Liu, A. Y. et al., *J. Immunol.* 139:3521–3526 (1987); Sun, L. K. et al., *Proc. Natl. Acad. Sci. USA* 84:214–218 (1987); Nishimura, Y. et al., *Canc. Res.* 47:999–1005

(1987); Wood, C. R. et al., *Nature* 314:446–449 (1985)); Shaw et al., *J. Natl. Cancer Inst.* 80:1553–1559 (1988). General reviews of "humanized" chimeric antibodies are provided by Morrison, S. L. (*Science,* 229:1202–1207 (1985)) and by Oi, V. T. et al., *BioTechniques* 4:214 (1986)). Suitable "humanized" antibodies can be alternatively produced by CDR or CEA substitution (Jones, P. T. et al., *Nature* 321:552–525 (1986); Verhoeyan et al., Science 239:1534 (1988); Beidler, C. B. et al., *J. Immunol.* 141:4053–4060 (1988)).

Suitable enzyme labels include, for example, those from the oxidase group, which catalyze the production of hydrogen peroxide by reacting with substrate. Glucose oxidase is particularly preferred as it has good stability and its substrate (glucose) is readily available. Activity of an oxidase label may be assayed by measuring the concentration of hydrogen peroxide formed by the enzyme-labeled antibody/substrate reaction. Besides enzymes, other suitable labels include radioisotopes, such as iodine ($^{125}$I, $^{121}$I), carbon ($^{14}$C), sulphur ($^{35}$S), tritium ($^{3}$H), indium ($^{112}$In), and technetium ($^{99m}$Tc), and fluorescent labels, such as fluorescein and rhodamine, and biotin.

Further suitable labels for the *Streptococcus* polypeptide-specific antibodies of the present invention are provided below. Examples of suitable enzyme labels include malate dehydrogenase, staphylococcal nuclease, delta-5-steroid isomerase, yeast-alcohol dehydrogenase, alpha-glycerol phosphate dehydrogenase, triose phosphate isomerase, peroxidase, alkaline phosphatase, asparaginase, glucose oxidase, beta-galactosidase, ribonuclease, urease, catalase, glucose-6-phosphate dehydrogenase, glucoamylase, and acetylcholine esterase.

Examples of suitable radioisotopic labels include $_3$H, $^{111}$In, $^{125}$I, $^{131}$I, $^{32}$P, $^{35}$S, $^{14}$C, $^{51}$Cr, $^{57}$To, $^{58}$Co, $^{59}$Fe, $^{72}$Se, $^{152}$Eu, $^{90}$Y, $^{67}$Cu, $^{217}$Ci, $^{211}$At, $^{212}$Pb, $^{47}$Sc, $^{109}$Pd, etc. $^{111}$In is a preferred isotope where in vivo imaging is used since its avoids the problem of dehalogenation of the $^{125}$I or $^{131}$I-labeled monoclonal antibody by the liver. In addition, this radionucleotide has a more favorable gamma emission energy for imaging (Perkins et al., *Eur. J. Nucl. Med.* 10:296–301 (1985); Carasquillo et al., *J. Nuc. Med* 28:281–287 (1987)). For example, $^{111}$In coupled to monoclonal antibodies with 1-(P-isothiocyanatobenzyl)-DPTA has shown little uptake in non-tumorous tissues, particularly the liver, and therefore enhances specificity of tumor localization (Esteban et al., *J. Nucl. Med.* 28:861–870 (1987)).

Examples of suitable non-radioactive isotopic labels include $^{157}$Gd, $^{35}$Mn, $^{162}$Dy, $^{52}$Tr, and $^{56}$Fe.

Examples of suitable fluorescent labels include an $^{152}$Eu label, a fluorescein label, an isothiocyanate label, a rhodamine label, a phycoerythrin label, a phycocyanin label, an allophycocyanin label, an o-phthaldehyde label, and a fluorescamine label.

Examples of suitable toxin labels include diphtheria toxin, ricin, and cholera toxin.

Examples of chemiluminescent labels include a luminal label, an isoluminal label, an aromatic acridinium ester label, an imidazole label, an acridinium salt label, an oxalate ester label, a luciferin label, a luciferase label, and an aequorin label.

Examples of nuclear magnetic resonance contrasting agents include heavy metal nuclei such as Gd, Mn, and iron.

Typical techniques for binding the above-described labels to antibodies are provided by Kennedy et al., *Clin. Chim. Acta* 70:1–31 (1976), and Schurs et al., *Clin. Chim. Acta* 81:1–40 (1977). Coupling techniques mentioned in the latter are the glutaraldehyde method, the periodate method, the dimaleimide method, the m-maleimidobenzyl-N-hydroxysuccinimide ester method, all of which methods are incorporated by reference herein.

In a related aspect, the invention includes a diagnostic kit for use in screening serum containing antibodies specific against *S. pneumoniae* infection. Such a kit may include an isolated *S. pneumoniae* antigen comprising an epitope which is specifically immunoreactive with at least one anti-*S. pneumoniae* antibody. Such a kit also includes means for detecting the binding of said antibody to the antigen. In specific embodiments, the kit may include a recombinantly produced or chemically synthesized peptide or polypeptide antigen. The peptide or polypeptide antigen may be attached to a solid support.

In a more specific embodiment, the detecting means of the above-described kit includes a solid support to which said peptide or polypeptide antigen is attached. Such a kit may also include a non-attached reporter-labelled anti-human antibody. In this embodiment, binding of the antibody to the *S. pneumoniae* antigen can be detected by binding of the reporter labelled antibody to the anti *S. pneumoniae* antibody.

In a related aspect, the invention includes a method of detecting *S. pneumoniae* infection in a subject. This detection method includes reacting a body fluid, preferably serum, from the subject with an isolated *S. pneumoniae* antigen, and examining the antigen for the presence of bound antibody. In a specific embodiment, the method includes a polypeptide antigen attached to a solid support, and serum is reacted with the support. Subsequently, the support is reacted with a reporter-labelled anti-human antibody. The support is then examined for the presence of reporter-labelled antibody.

The solid surface reagent employed in the above assays and kits is prepared by known techniques for attaching protein material to solid support material, such as polymeric beads, dip sticks, 96-well plates or filter material. These attachment methods generally include non-specific adsorption of the protein to the support or covalent attachment of the protein, typically through a free amine group, to a chemically reactive group on the solid support, such as an activated carboxyl, hydroxyl, or aldehyde group. Alternatively, streptavidin coated plates can be used in conjunction with biotinylated antigen(s).

Therapeutics and Modes of Administration

The present invention also provides vaccines comprising one or more polypeptides of the present invention. Heterogeneity in the composition of a vaccine may be provided by combining *S. pneumoniae* polypeptides of the present invention. Multi-component vaccines of this type are desirable because they are likely to be more effective in eliciting protective immune responses against multiple species and strains of the *Streptococcus* genus than single polypeptide vaccines. Thus, as discussed in detail below, a multi-component vaccine of the present invention may contain one or more, preferably 2 to about 20, more preferably 2 to about 15, and most preferably 3 to about 8, of the *S. pneumoniae* polypeptides identified in Table 1, or fragments thereof.

Multi-component vaccines are known in the art to elicit antibody production to numerous immunogenic components. Decker, M. and Edwards, K, *J. Infect. Dis.* 174:S270–275 (1996). In addition, a hepatitis B, diphtheria, tetanus, pertussis tetravalent vaccine has recently been demonstrated to elicit protective levels of antibodies in human infants against all four pathogenic agents. Aristegui, J. et al., *Vaccine* 15:7–9 (1997).

The present invention thus also includes multi-component vaccines. These vaccines comprise more than one polypeptide, immunogen or antigen. An example of such a multi-component vaccine would be a vaccine comprising more than one of the *S. pneumoniae* polypeptides described in Table 1. A second example is a vaccine comprising one or more, for example 2 to 10, of the *S. pneumoniae* polypeptides identified in Table 1 and one or more, for example 2 to 10, additional polypeptides of either streptococcal or non-streptococcal origin. Thus, a multi-component vaccine which confers protective immunity to both a Streptococcal infection and infection by another pathogenic agent is also within the scope of the invention.

As indicated above, the vaccines of the present invention are expected to elicit a protective immune response against infections caused by species and strains of *Streptococcus* other than strain of *S. pneumoniae* deposited with that ATCC.

Further within the scope of the invention are whole cell and whole viral vaccines. Such vaccines may be produced recombinantly and involve the expression of one or more of the *S. pneumoniae* polypeptides described in Table 1. For example, the *S. pneumoniae* polypeptides of the present invention may be either secreted or localized intracellular, on the cell surface, or in the periplasmic space. Further, when a recombinant virus is used, the *S. pneumoniae* polypeptides of the present invention may, for example, be localized in the viral envelope, on the surface of the capsid, or internally within the capsid. Whole cells vaccines which employ cells expressing heterologous proteins are known in the art. See, e.g., Robinson, K. et al., *Nature Biotech.* 15:653–657 (1997); Sirard, J. et al., *Infect Immun.* 65:2029–2033 (1997); Chabalgoity, J. et al., *Infect. Immun.* 65:2402–2412 (1997). These cells may be administered live or may be killed prior to administration. Chabalgoity, J. et al., supra, for example, report the successful use in mice of a live attenuated *Salmonella* vaccine strain which expresses a portion of a platyhelminth fatty acid-binding protein as a fusion protein on its cells surface.

A multi-component vaccine can also be prepared using techniques known in the art by combining one or more *S. pneumoniae* polypeptides of the present invention, or fragments thereof, with additional non-streptococcal components (e.g., diphtheria toxin or tetanus toxin, and/or other compounds known to elicit an immune response). Such vaccines are useful for eliciting protective immune responses to both members of the *Streptococcus* genus and non-streptococcal pathogenic agents.

The vaccines of the present invention also include DNA vaccines. DNA vaccines are currently being developed for a number of infectious diseases. Boyer, J et al., *Nat. Med.* 3:526–532 (1997); reviewed in Spier, R., *Vaccine* 14:1285–1288 (1996). Such DNA vaccines contain a nucleotide sequence encoding one or more *S. pneumoniae* polypeptides of the present invention oriented in a manner that allows for expression of the subject polypeptide. The direct administration of plasmid DNA encoding *B. burgdorferi* OspA has been shown to elicit protective immunity in mice against borrelial challenge. Luke, C. et al., *J. Infect. Dis.* 175:91–97 (1997).

The present invention also relates to the administration of a vaccine which is co-administered with a molecule capable of modulating immune responses. Kim, J. et al., *Nature Biotech.* 15:641–646 (1997), for example, report the enhancement of immune responses produced by DNA immunizations when DNA sequences encoding molecules which stimulate the immune response are co-administered. In a similar fashion, the vaccines of the present invention may be co-administered with either nucleic acids encoding immune modulators or the immune modulators themselves. These immune modulators include granulocyte macrophage colony stimulating factor (GM-CSF) and CD86.

The vaccines of the present invention may be used to confer resistance to streptococcal infection by either passive or active immunization. When the vaccines of the present invention are used to confer resistance to streptococcal infection through active immunization, a vaccine of the present invention is administered to an animal to elicit a protective immune response which either prevents or attenuates a streptococcal infection. When the vaccines of the present invention are used to confer resistance to streptococcal infection through passive immunization, the vaccine is provided to a host animal (e.g., human, dog, or mouse), and the antisera elicited by this antisera is recovered and directly provided to a recipient suspected of having an infection caused by a member of the *Streptococcus* genus.

The ability to label antibodies, or fragments of antibodies, with toxin molecules provides an additional method for treating streptococcal infections when passive immunization is conducted. In this embodiment, antibodies, or fragments of antibodies, capable of recognizing the *S. pneumoniae* polypeptides disclosed herein, or fragments thereof, as well as other *Streptococcus* proteins, are labeled with toxin molecules prior to their administration to the patient. When such toxin derivatized antibodies bind to *Streptococcus* cells, toxin moieties will be localized to these cells and will cause their death.

The present invention thus concerns and provides a means for preventing or attenuating a streptococcal infection resulting from organisms which have antigens that are recognized and bound by antisera produced in response to the polypeptides of the present invention. As used herein, a vaccine is said to prevent or attenuate a disease if its administration to an animal results either in the total or partial attenuation (i.e., suppression) of a symptom or condition of the disease, or in the total or partial immunity of the animal to the disease.

The administration of the vaccine (or the antisera which it elicits) may be for either a "prophylactic" or "therapeutic" purpose. When provided prophylactically, the compound(s) are provided in advance of any symptoms of streptococcal infection. The prophylactic administration of the compound(s) serves to prevent or attenuate any subsequent infection. When provided therapeutically, the compound(s) is provided upon or after the detection of symptoms which indicate that an animal may be infected with a member of the *Streptococcus* genus. The therapeutic administration of the compound(s) serves to attenuate any actual infection. Thus, the *S. pneumoniae* polypeptides, and fragments thereof, of the present invention may be provided either prior to the onset of infection (so as to prevent or attenuate an anticipated infection) or after the initiation of an actual infection.

The polypeptides of the invention, whether encoding a portion of a native protein or a functional derivative thereof, may be administered in pure form or may be coupled to a macromolecular carrier. Example of such carriers are proteins and carbohydrates. Suitable proteins which may act as macromolecular carrier for enhancing the immunogenicity of the polypeptides of the present invention include keyhole limpet hemacyanin (KLH) tetanus toxoid, pertussis toxin, bovine serum albumin, and ovalbumin. Methods for coupling the polypeptides of the present invention to such macromolecular carriers are disclosed in Harlow et al., *Antibodies: A Laboratory Manual,* 2nd Ed.; Cold Spring Harbor Laboratory Press, Cold Spring Harbor, N.Y. (1988), the entire disclosure of which is incorporated by reference herein.

A composition is said to be "pharmacologically acceptable" if its administration can be tolerated by a recipient animal and is otherwise suitable for administration to that animal. Such an agent is said to be administered in a "therapeutically effective amount" if the amount administered is physiologically significant. An agent is physiologically significant if its presence results in a detectable change in the physiology of a recipient patient.

While in all instances the vaccine of the present invention is administered as a pharmacologically acceptable compound, one skilled in the art would recognize that the composition of a pharmacologically acceptable compound varies with the animal to which it is administered. For example, a vaccine intended for human use will generally not be co-administered with Freund's adjuvant. Further, the level of purity of the S. pneumoniae polypeptides of the present invention will normally be higher when administered to a human than when administered to a non-human animal.

As would be understood by one of ordinary skill in the art, when the vaccine of the present invention is provided to an animal, it may be in a composition which may contain salts, buffers, adjuvants, or other substances which are desirable for improving the efficacy of the composition. Adjuvants are substances that can be used to specifically augment a specific immune response. These substances generally perform two functions: (1) they protect the antigen(s) from being rapidly catabolized after administration and (2) they non-specifically stimulate immune responses.

Normally, the adjuvant and the composition are mixed prior to presentation to the immune system, or presented separately, but into the same site of the animal being immunized. Adjuvants can be loosely divided into several groups based upon their composition. These groups include oil adjuvants (for example, Freund's complete and incomplete), mineral salts (for example, $AlK(SO_4)_2$, $AlNa(SO_4)_2$, $AlNH_4(SO_4)$, silica, kaolin, and carbon), polynucleotides (for example, poly IC and poly AU acids), and certain natural substances (for example, wax D from Mycobacterium tuberculosis, as well as substances found in Corynebacterium parvum, or Bordetella pertussis, and members of the genus Brucella. Other substances useful as adjuvants are the saponins such as, for example, Quil A. (Superfos A/S, Denmark). Preferred adjuvants for use in the present invention include aluminum salts, such as $AlK(SO_4)_2$, $AlNa(SO_4)_2$, and $AlNH_4(SO_4)$. Examples of materials suitable for use in vaccine compositions are provided in Remington's Pharmaceutical Sciences (Osol, A, Ed, Mack Publishing Co, Easton, Pa., pp. 1324–1341 (1980), which reference is incorporated herein by reference).

The therapeutic compositions of the present invention can be administered parenterally by injection, rapid infusion, nasopharyngeal absorption (intranasopharangeally), dermoabsorption, or orally. The compositions may alternatively be administered intramuscularly, or intravenously. Compositions for parenteral administration include sterile aqueous or non-aqueous solutions, suspensions, and emulsions. Examples of non-aqueous solvents are propylene glycol, polyethylene glycol, vegetable oils such as olive oil, and injectable organic esters such as ethyl oleate. Carriers or occlusive dressings can be used to increase skin permeability and enhance antigen absorption. Liquid dosage forms for oral administration may generally comprise a liposome solution containing the liquid dosage form. Suitable forms for suspending liposomes include emulsions, suspensions, solutions, syrups, and elixirs containing inert diluents commonly used in the art, such as purified water. Besides the inert diluents, such compositions can also include adjuvants, wetting agents, emulsifying and suspending agents, or sweetening, flavoring, or perfuming agents.

Therapeutic compositions of the present invention can also be administered in encapsulated form. For example, intranasal immunization of mice against Bordetella pertussis infection using vaccines encapsulated in biodegradable microsphere composed of poly(DL-lactidco-glycolide) has been shown to stimulate protective immune responses. Shahin, R. et al., Infect. Immun. 63:1195–1200 (1995). Similarly, orally administered encapsulated Salmonella typhimurium antigens have also been shown to elicit protective immunity in mice. Allaoui-Attarki, K. et al., Infect. Immun. 65:853–857 (1997). Encapsulated vaccines of the present invention can be administered by a variety of routes including those involving contacting the vaccine with mucous membranes (e.g., intranasally, intracolonicly, intraduodenally).

Many different techniques exist for the timing of the immunizations when a multiple administration regimen is utilized. It is possible to use the compositions of the invention more than once to increase the levels and diversities of expression of the immunoglobulin repertoire expressed by the immunized animal. Typically, if multiple immunizations are given, they will be given one to two months apart.

According to the present invention, an "effective amount" of a therapeutic composition is one which is sufficient to achieve a desired biological effect. Generally, the dosage needed to provide an effective amount of the composition will vary depending upon such factors as the animal's or human's age, condition, sex, and extent of disease, if any, and other variables which can be adjusted by one of ordinary skill in the art.

The antigenic preparations of the invention can be administered by either single or multiple dosages of an effective amount. Effective amounts of the compositions of the invention can vary from 0.01–1,000 g/ml per dose, more preferably 0.1–500 µg/ml per dose, and most preferably 10–300 µg/ml per dose.

Having now generally described the invention, the same will be more readily understood through reference to the following example which is provided by way of illustration, and is not intended to be limiting of the present invention, unless specified.

EXAMPLES

Example 1

Expression and Purification of S. pneumoniae Polypeptides in E. coli

The bacterial expression vector pQE10 (QIAGEN, Inc., 9259 Eton Avenue, Chatsworth, Calif., 91311) is used in this example for cloning of the nucleotide sequences shown in Table 1 and for expressing the polypeptides identified in Table 1. The components of the PQEIO plasmid are arranged such that the inserted DNA sequence encoding a polypeptide of the present invention expresses the polypeptide with the six His residues (i.e., a "6xHis tag")) covalently linked to the amino terminus.

The DNA sequences encoding the desired portions of the polypeptides of Table 1 are amplified using PCR oligonucleotide primers from either a DNA library constructed from S. pneumoniae, such as the one deposited by the inventors at the ATCC for convenience, ATCC Deposit No. 97755, or from DNA isolated from the same organism such as the S. pneumoniae strain deposited with the ATCC as Deposit No.

55840. A list of PCR primers which can be used for this purpose is provided in Table 3, below. The PCR primers anneal to the nucleotide sequences encoding both the amino terminal and carboxy terminal amino acid sequences of the desired portion of the polypeptides of Table 1. Additional nucleotides containing restriction sites to facilitate cloning in the PQEIO vector were added to the 5' and 3' primer sequences, respectively. Such restriction sites are listed in Table 3 for each primer. In each case, the primer comprises, from the 5' end, 4 random nucleotides to prevent "breathing" during the annealing process, a restriction site (shown in Table 3), and approximately 15 nucleotides of S. pneumoniae ORF sequence (the complete sequence of each cloning primer is shown as SEQ ID NO:227 through SEQ ID NO:452).

For cloning the polypeptides of Table 1, the 5' and 3' primers were selected to amplify their respective nucleotide coding sequences. One of ordinary skill in the art would appreciate that the point in the protein coding sequence where the 5' primer begins may be varied to amplify a DNA segment encoding any desired portion of the complete amino acid sequences described in Table 1. Similarly, one of ordinary skill in the art would further appreciate that the point in the protein coding sequence where the 3' primer begins may also be varied to amplify a DNA segment encoding any desired portion of the complete amino acid sequences described in Table 1.

The amplified DNA fragment and the PQEIO vector are digested with the appropriate restriction enzyme(s) and the digested DNAs are then ligated together. The ligation mixture is transformed into competent E. coli cells using standard procedures such as those described in Sambrook et al., *Molecular Cloning: a Laboratory Manual*, 2nd Ed.; Cold Spring Harbor Laboratory Press, Cold Spring Harbor, N.Y. (1989). Transformants are identified by their ability to grow under selective pressure on LB plates. Plasmid DNA is isolated from resistant colonies and the identity of the cloned DNA confirmed by restriction analysis, PCR and DNA sequencing.

Clones containing the desired constructs are grown overnight ("O/N") in liquid culture under selection. The O/N culture is used to inoculate a large culture, at a dilution of approximately 1:25 to 1:250. The cells are grown to an optical density at 600 nm ("OD600") of between 0.4 and 0.6. Isopropyl-b-D-thiogalactopyranoside ("IPTG") is then added to a final concentration of 1 mM to induce transcription from the lac repressor sensitive promoter, by inactivating the lacI repressor. Cells subsequently are incubated further for 3 to 4 hours. Cells are then harvested by centrifugation.

The cells are stirred for 34 hours at 4 C in 6 M guanidine-HCl, pH 8. The cell debris is removed by centrifugation, and the supernatant containing the protein of interest is loaded onto a nickel-nitrilo-tri-acetic acid ("NiNTA") affinity resin column (available from QIAGEN, Inc., supra). Proteins with a 6×His tag bind to the NI-NTA resin with high affinity and can be purified in a simple one-step procedure (for details see: The QIAexpressionist, 1995, QLAGEN, Inc., supra). Briefly, the supernatant is loaded onto the column in 6 M guanidine-HCl, pH8, the column is first washed with 10 volumes of 6 M guanidine-HCl, pH8, then washed with 10 volumes of 6 M guanidine-HCl pH6, and finally the polypeptide is eluted with 6 M guanidine-HCl, pH 5.0.

The purified protein is then renatured by dialyzing it against phosphate-buffered saline (PBS) or 50 mM Na-acetate, pH 6 buffer plus 200 mM NaCl. Alternatively, the protein can be successfully refolded while immobilized on the Ni-NTA column. The recommended conditions are as follows: renature using a linear 6M-1M urea gradient in 500 mM NaCl, 20% glycerol, 20 mM Tris/HCl pH7.4, containing protease inhibitors. The renaturation should be performed over a period of 1.5 hours or more. After renaturation the proteins can be eluted by the addition of 250 mM imidazole. Imidazole is removed by a final dialyzing step against PBS or 50 mM sodium acetate pH6 buffer plus 200 mM NaCl. The purified protein is stored at 4° C. or frozen at −80° C.

The DNA sequences encoding the amino acid sequences of Table 1 may also be cloned and expressed as fusion proteins by a protocol similar to that described directly above, wherein the pET-32b(+) vector (Novagen, 601 Science Drive, Madison, Wis. 53711) is preferentially used in place of pQE10.

Each of the polynucleotides shown in Table 1, was successfully amplified and subcloned into pQE10 as described above using the PCR primers shown in Table 3. These pQE10 plasmids containing the DNAs of Table 1, except SP023, SP042, SP054, SP063, SP081, SP092, SP114, SP122, SP123, SP126, and SP127, were deposited with the ATCC as a pooled deposit as a convenience to those of skill in the art. This pooled deposit was desposited on Oct. 16, 1997 and given ATCC Deposit No. 209369. Those of ordinary skill in the art appreciate that isolating an individual plasmid from the pooled deposit is trivial provided the information and reagents described herein. Each of the deposited clones is capable of expressing its encoded S. pneumoniae polypeptide.

Example 2

Immunization and Detection of Immune Responses
Methods
Growth of Bacterial Innoculum, Immunization of Mice and Challenge with S. pneumoniae.

Propagation and storage of, and challenge by S. pneumoniae are preformed essentially as described in Aaberge, I. S. et al., Virulence of *Streptococcus pneumoniae* in mice: a standardized method for preparation and frozen storage of the experimental bacterial inoculum, *Microbial Pathogenesis*, 18:141 (1995), incorporated herein by reference.

Briefly, Todd Hewitt (TH) broth (Difco laboratories, Detroit, Mich.) with 17% FCS, and horse blood agar plates are used for culturing the bacteria Both broth and blood plates are incubated at 37° C. in a 5% $CO_2$ atmosphere. Blood plates are incubated for 18 hr. The culture broth is regularly 10-fold serially diluted in TH broth kept at room temperature and bacterial suspensions are kept at room temperature until challenge of mice.

For active immunizations C3H/HeJ mice (The Jackson Laboratory, Bar Harbor, Me.) are injected intraperitoneally (i.p.) at week 0 with 20 g of recombinant streptococcal protein, or phosphate-buffered saline (PBS), emulsified with complete Freund's adjuvant (CFA), given a similar booster immunization in incomplete Freund's adjuvant (IFA) at week 4, and challenged at week 6. For challenge S. pneumoniae are diluted in TH broth from exponentially-growing cultures and mice are injected subcutaneously (s.c.) at the base of the tail with 0.1 ml of these dilutions (serial dilutions are used to find medium infectious dose). Streptococci used for challenge are passaged fewer than six times in vitro. To assess infection, blood samples are obtained from the distal part of the lateral femoral vein into heparinized capillary tubes. A 25 ul blood sample is serially 10-fold diluted in TH broth, and 25 ul of diluted and undiluted blood is plated onto blood agar plates. The plates are incubated for 18 hr. and colonies are counted.

Other methods are known in the art, for example, see Langermann, S. et al., *J. Exp. Med.*, 180:2277 (1994), incorporated herein by reference.

Immunoassays

Several immunoassay formats are used to quantify levels of streptococcal-specific antibodies (ELISA and immunoblot), and to evaluate the functional properties of these antibodies (growth inhibition assay). The ELISA and immunoblot assays are also used to detect and quantify antibodies elicited in response to streptococcal infection that react with specific streptococcal antigens. Where antibodies to certain streptococcal antigens are elicited by infection this is taken as evidence that the streptococcal proteins in question are expressed in vivo. Absence of infection-derived antibodies (seroconversion) following streptococcal challenge is evidence that infection is prevented or suppressed. The immunoblot assay is also used to ascertain whether antibodies raised against recombinant streptococcal antigens recognize a protein of similar size in extracts of whole streptococci. Where the natural protein is of similar, or identical, size in the immunoblot assay to the recombinant version of the same protein, this is taken as evidence that the recombinant protein is the product of a full-length clone of the respective gene.

Enzyme-Linked Immunosorbant Assay (ELISA).

The ELISA is used to quantify levels of antibodies reactive with *streptococcus* antigens elicited in response to immunization with these streptococcal antigens. Wells of 96 well microtiter plates (Immunlon 4, Dynatech, Chantilly, Virginia, or equivalent) are coated with antigen by incubating 50 1 of 1 g/ml protein antigen solution in a suitable buffer, typically 0.1 M sodium carbonate buffer at pH 9.6. After decanting unbound antigen, additional binding sites are blocked by incubating 100 1 of 3% nonfat milk in wash buffer (PBS, 0.2% Tween 20, pH 7.4). After washing, duplicate serial two-fold dilutions of sera in PBS, Tween 20, 1% fetal bovine serum, are incubated for 1 hr, removed, wells are washed three times, and incubated with horseradish peroxidase-conjugated goat anti-mouse IgG. After three washes, bound antibodies are detected with $H_2O_2$ and 2,2'-azino-di-(3-ethylbenzthiazoline sulfonate) (Schwan, T. G., et al., *Proc. Natl. Acad. Sci. USA* 92:2909–2913 (1985)) (ABTS®, Kirkegaard & Perry Labs., Gaithersburg, Md.) and $A_{405}$ is quantified with a Molecular Devices, Corp. (Menlo Park, Calif.) Vmax™ plate reader. IgG levels twice the background level in serum from naive mice are assigned the minimum titer of 1:100.

Sodiumdodecylsulfate-Polyacrylamide Gel Electrophoresis (SDS-PAGE) and Immunoblotting Using a single well format, total streptococcal protein extracts or recombinant streptococcal antigen are boiled in SDS/2-ME sample buffer before electrophoresis through 3% acrylamide stacking gels, and resolving gels of higher acrylamide concentration, typically 10–15% acrylamide monomer. Gels are electro-blotted to nitrocellulose membranes and lanes are probed with dilutions of antibody to be tested for reactivity with specific streptococcal antigens, followed by the appropriate secondary antibody-enzyme (horseradish peroxidase) conjugate. When it is desirable to confirm that the protein had transferred following electro-blotting, membranes are stained with Ponceau S. Immunoblot signals from bound antibodies are detected on x-ray film as chemiluminescence using ECL™ reagents (Amersharn Corp., Arlington Heights, Ill.).

Example 3

Detection of *Streptococcus* mRNA Expression

Northern blot analysis is carried out using methods described by, among others, Sambrook et al., supra to detect the expression of the *S. pneumoniae* nucleotide sequences of the present invention in animal tissues. A cDNA probe containing an entire nucleotide sequence shown in Table 1 is labeled with $^{32}P$ using the rediprime™ DNA labeling system (Amersham Life Science), according to manufacturer's instructions. After labeling, the probe is purified using a CHROMA SPIN-100™ column (Clontech Laboratories, Inc.), according to manufacturer's protocol number PT1200-1. The purified labeled probe is then used to detect the expression of *Streptococcus* mRNA in an animal tissue sample.

Animal tissues, such as blood or spinal fluid, are examined with the labeled probe using ExpressHyb™ hybridization solution (Clontech) according to manufacturer's protocol number PT1190-1. Following hybridization and washing, the blots are mounted and exposed to film at −70° C. overnight, and films developed according to standard procedures.

It will be clear that the invention may be practiced otherwise than as particularly described in the foregoing description and examples.

Numerous modifications and variations of the present invention are possible in light of the above teachings and, therefore, are within the scope of the appended claims.

The entire disclosure of all publications (including patents, patent applications, journal articles, laboratory manuals, books, or other documents) cited herein are hereby incorporated by reference.

TABLE 1

SP001 nucleotide (SEQ ID NO:1)
TAAAATCTACGACAATAAAAATCAACTCATTGCTGACTTGGGTTCTGAACGCCGCGTCAATGCCCAAGC
TAATGATATTCCCACAGATTTGGTTAAGGCAATCGTTTCTATCGAAGACCATCGCTTCTTCGACCACAG
GGGGATTGATACCATCCGTATCCTGGGAGCTTTCTTGCGCAATCTGCAAAGCAATTCCCTCCAAGGTGG
ATCAACTCTCACCCAACAGTTGATTAAGTTGACTTACTTTTCAACTTCGACTTCCGACCAGACTATTTC
TCGTAAGGCTCAGGAAGCTTGGTTAGCGATTCAGTTAGAACAAAAAGCAACCAAGCAAGAAATCTTGAC
CTACTATATAAATAAGGTCTACATGTCTAATGGGAACTATGGAATGCAGACAGCAGCTCAAAACTACTA
TGGTAAAGACCTCAATAATTTAAGTTTACCTCAGTTAGCCTTGCTGGCTGGAATGCCTCAGGCACCAAA
CCAATATGACCCCTATTCACATCCAGAAGCAGCCCAAGACCGCCGAAACTTGGTCTTATCTGAAATGAA
AAATCAAGGCTACATCTCTGCTGAACAGTATGAGAAAGCAGTCAATACACCAATTACTGATGGACTACA
AAGTCTCAAATCAGCAAGTAATTACCCTGCTTACATGGATAATTACCTCAAGGAAGTCATCAATCAAGT
TGAAGAAGAAACAGGCTATAACCTACTCACAACTGGGATGGATGTCTACACAAATGTAGACCAAGAAGC
TCAAAAACATCTGTGGGATATTTACAATACAGACGAATACGTTGCCTATCCAGACGATGAATTGCAAGT
CGCTTCTACCATTGTTGATGTTTCTAACGGTAAAGTCATTGCCCAGCTAGGAGCACGCCATCAGTCAAG TABLE 1-continued

```
TAATGTTTCCTTCGGAATTAACCAAGCAGTAGAAACAAACCGCGACTGGGGATCAACTATGAAACCGAT
CACAGACTATGCTCCTGCCTTGGAGTACGGTGTCTACGATTCAACTGCTACTATCGTTCACGATGAGCC
CTATAACTACCCTGGGACAAATACTCCTGTTTATAACTGGGATAGGGGCTACTTTGGCAACATCACCTT
GCAATACGCCCTGCAACAATCGCGAAACGTCCCAGCCGTGGAAACTCTAAACAAGGTCGGACTCAACCG
CGCCAAGACTTTCCTAAATGGTCTAGGAATCGACTACCCAAGTATTCACTACTCAAATGCCATTTCAAG
TAACACAACCGAATCAGACAAAAAATATGGAGCAAGTAGTGAAAAGATGGCTGCTGCTTACGCTGCCTT
TGCAAATGGTGGAACTTACTATAAACCAATGTATATCCATAAAGTCGTCTTTAGTGATGGGAGTGAAAA
AGAGTTCTCTAATGTCGGAACTCGTGCCATGAAGGAAACGACAGCCTATATGATGACCGACATGATGAA
AACAGTCTTGACTTATGGAACTGGACGAAATGCCTATCTTGCTTGGCTCCCTCAGGCTGGTAAAACAGG
AACCTCTAACTATACAGACGAGGAAATTGAAAACCACATCAAGACCTCTCAATTTGTAGCACCTGATGA
ACTATTTGCTGGCTATACGCGTAAATATTCAATGGCTGTATGGACAGGCTATTCTAACCGTCTGACACC
ACTTGTAGGCAATGGCCTTACGGTCGCTGCCAAAGTTTACCGCTCTATGATGACCTACCTGTCTGAAGG
AAGCAATCCAGAAGATTGGAATATACCAGAGGGGCTCTACAGAAATGGAGAATTCGTATTTAAAAATGG
TGCTCGTTCTACGTGGAACTCACCTGCTCCACAACAACCCCCATCAACTGAAAGTTCAAGCTCATCATC
AGATAGTTCAACTTCACAGTCTAGCTCAACCACTCCAAGCACAAATAATAGTACGACTACCAATCCTAA
CAATAATACGCAACAATCAAATACAACCCCTGATCAACAAAATCAGAATCCTCAACCAGCACAACCA

SP001 AMINO ACID (SEQ ID NO:2)
KIYDNKNQLIADLGSERRVNAQANDIPTDLVKAIVSIEDHRFFDHRGIDTIRILGAFLRNLQSNSLQGG
STLTQQLIKLTYFSTSTSDQTISRKAQEAWLAIQLEQKATKQEILTYYINKVYMSNGNYGMQTAAQNYY
GKDLNNLSLPQLALLAGMPQAPNQYDPYSHPEAAQDRRNLVLSEMKNQGYISAEQYEKAVNTPITDGLQ
SLKSASNYPAYMDNYLKEVINQVEEETGYNLLTTGMDVYTNVDQEAQKHLWDIYNTDEYVAYPDDELQV
ASTIVDVSNGKVIAQLGARHQSSNVSFGINQAVETNRDWGSTMKPITDYAPALEYGVYDSTATIVHDEP
YNYPGTNTPVYNWDRGYFGNITLQYALQQSRNVPAVETLNKVGLNRAKTFLNGLGIDYPSIHYSNAISS
NTTESDKKYGASSEKMAAAYAAFANGGTYYKPMYIHKVVFSDGSEKEFSNVGTRAMKETTAYMMTDMMK
TVLTYGTGRNAYLAWLPQAGKTGTSNYTDEEIENHIKTSQFVAPDELFAGYTRKYSMAVWTGYSNRLTP
LVGNGLTVAAKVYRSMMTYLSEGSNPEDWNIPEGLYRNGEFVFKNGARSTWNSPAPQQPPSTESSSSSS
DSSTSQSSSTTPSTNNSTTTNPNNNTQQSNTTPDQQNQNPQPAQP

SP004 nucleotide (SEQ ID NO:3)
AAATTACAATACGGACTATGAATTGACCTCTGGAGAAAAATTACCTCTTCCTAAAGAGATTTCAGGTTA
CACTTATATTGGATATATCAAAGAGGGAAAAACGACTTCTGAGTCTGAAGTAAGTAATCAAAAGAGTTC
AGTTGCCACTCCTACAAAACAACAAAAGGTGGATTATAATGTTACACCGAATTTTGTAGACCATCCATC
AACAGTACAAGCTATTCAGGAACAAACACCTGTTTCTTCAACTAAGCCGACAGAAGTTCAAGTAGTTCA
AAAACCTTTCTCTACTGAATTAATCAATCCAAGAAAAGAAGAGAAACAATCTTCAGATTCTCAAGAACA
ATTAGCCGAACATAAGAATCTAGAAACGAAGAAAGAGGAGAAGATTTCTCCAAAAGAAAAGACTGGGGT
AAATACATTAAATCCACAGGATGAAGTTTTATCAGGTCAATTGAACAAACCTGAACTCTTATATCGTGA
GGAAACTATGGAGACAAAAATAGATTTTCAAGAAGAAATTCAAGAAAATCCTGATTAGCTGAAGGAAC
TGTAAGAGTAAAACAAGAAGGTAAATTAGGTAAGAAAGTTGAAATCGTCAGAATATTCTCTGTAAACAA
GGAAGAAGTTTCGCGAGAAATTGTTTCAACTTCAACGACTGCGCCTAGTCCAAGAATAGTCGAAAAAGG
TACTAAAAAAACTCAAGTTATAAAGGAACAACCTGAGACTGGTGTGTAGAACATAAGGACGTACAGTCTGG
AGCTATTGTTGAACCCGCAATTCAGCCTGAGTTGCCCGAAGCTGTAGTAAGTGACAAAGGCGAACCAGA
AGTTCAACCTACATTACCCGAAGCAGTTGTGACCGACAAAGGTGAGACTGAGGTTCAACCAGAGTCGCC
AGATACTGTGGTAAGTGATAAAGGTGAACCAGAGCAGGTAGCACCGCTTCCAGAATATAAGGGTAATAT
TGAGCAAGTAAAACCTGAAACTCCGGTTGAGAAGACCAAAGAACAAGGTCCAGAAAAACTGAAGAAGT
TCCAGTAAAACCAACAGAAGAAACACCAGTAAATCCAAATGAAGGTACTACAGAAGGAACCTCAATTCA
AGAAGCAGAAAATCCAGTTCAACCTGCAGAAGAATCAACAACGAATTCAGAGAAAGTATCACCAGATAC
ATCTAGCAAAAATACTGGGGAAGTGTCCAGTAATCCTAGTGATTCGACAACCTCAGTTGGAGAATCAAA
TAAACCAGAACATAATGACTCTAAAAATGAAAATTCAGAAAAAACTGTAGAAGAAGTTCCAGTAAATCC
AAATGAAGGCACAGTAGAAGGTACCTCAAATCAAGAAACAGAAAAACCAGTTCAACCTGCAGAAGAAAC
ACAAACAAACTCTGGGAAAATAGCTAACGAAAATACTGGAGAAGTATCCAATAAACCTAGTGATTCAAA
ACCACCAGTTGAAGAATCAAATCAACCAGAAAAAAAACGGAACTGCAACAAAACCAGAAAATTCAGGTAA
TACAACATCAGAGAATGGACAAACAGAACCAGAACCATCAAACGGAAATTCAACTGAGGATGTTTCAAC
CGAATCAAACACATCCAATTCAAATGGAAACGAAGAAATTAAACAAGAAATGAACTAGACCCTGATAA
AAAGGTAGAACAACGAGAGAAAACACTTGAATTAAGAAATGTTTCCGACCTAGAGTTA SP004 amino acid (SEQ ID NO:4)
NYNTDYELTSGEKLPLPKEISGYTYIGYIKEGKTTSESEVSNQKSSVATPTKQQKVDYNVTPNFVDHPS
TVQAIQEQTPVSSTKPTEVQVVEKPFSTELINPRKEEKQSSDSQEQLAEHKNLETKKEEKISPKEKTGV
NTLNPQDEVLSGQLNKPELLYREETMETKIDFQEEIQENPDLAEGTVRVKQEGKLGKKVEIVRIFSVNK
EEVSREIVSTSTTAPSPRIVEKGTKKTQVIKEQPETGVEHKDVQSGAIVEPAIQPELPEAVVSDKGEPE
VQPTLPEAVVTDKGETEVQPESPDTVVSDKGEPEQVAPLPEYKGNIEQVKPETPVEKTKEQGPEKTEEV
PVKPTEETPVNPNEGTTEGTSIQEAENPVQPAEESTTNSEKVSPDTSSKNTGEVSSNPSDSTTSVGESN
KPEHNDSKNENSEKTVEEVPVNPNEGTVEGTSNQETEKPVQPAEETQTNSGKIANENTGEVSNKPSDSK
PPVEESNQPEKNGTATKPENSGNTTSENGQTEPEPSNGNSTEDVSTESNTSNSNGNEEIKQENELDPDK
KVEEPEKTLELRNVSDLEL SP006 nucleotide (SEQ ID NO:5)
TGAGAATCAAGCTACACCCAAAGAGACTAGCGCTGAAAAGACAATCGTCCTTGCTACAGCTGGCGACGT
GCCACCATTTGACTACGAAGACAAGGGCAATCTGACAGGCTTTGATATCGAAGTTTAAAGGCAGTAGA
TGAAAAACTCAGCGACTACGAGATTCAATTCCAAAGAACCGCCTGGGAGAGCATCTTCCCAGGACTTGA
TTCTGGTCACTATCAGGCTGCGGCCAATAACTTGAGTTACACAAAAGAGCGTGCTGAAAAATACCTTTA
CTCGCTTCCAATTTCCAACAATCCCCTCGTCCTTGTCAGCAACAAGAAAAATCCTTTGACTTCTCTTGA
CCAGATCGCTGGTAAAACAACACAAGAGGATACCGGAACTTCTAACGCTCAATTCATCAATAACTGGAA
TCAGAAACACACTGATAATCCCGCTACAATTAATTTTTCTGGTGAGGATATTGGTAAACGAATCCTAGA
CCTTGCTAACGAGAGTTTGATTTCCTAGTTTTTGACAAGGTATCCGTTCAAAAGATTATCAAGGACCG
TGGTTTAGACCTCTCAGTCGTTGATTTACCTTCTGCAGATAGCCCCAGCAATTATATCATTTTCTCAAG
CGACCAAAAAGAGTTTAAAGAGCAATTTGATAAAGCGCTCAAAGAACTCTATCAAGACGAACCCTTGA
AAAACTCAGCAATACCTATCTAGGTGGTTCTTACCTCCCAGATCAATCTCAGTTACAA
```

TABLE 1-continued

SP006 amino acid (SEQ ID NO:6)
ENQATPKETSAQKTIVLATAGDVPPFDYEDKGNLTGFDIEVLKAVDEKLSDYEIQFQRTAWESIFPGLD
SGHYQAAANNLSYTKERAEKYLYSLPISNNPLVLVSNKKNPLTSLDQIAGKTTQEDTGTSNAQFINNWN
QKHTDNPATINFSGEDIGKRILDLANGEFDFLVFDKVSVQKIIKDRGLDLSVVDLPSADSPSNYIIFSS
DQKEFKEQFDKALKELYQDGTLEKLSNTYLGGSYLPDQSQLQ SP007 nucleotide (SEQ ID NO:7)
TGGTAACCGCTCTTCTCGTAACGCAGCTTCATCTTCTGATGTGAAGACAAAAGCAGCAATCGTCACTGA
TACTGGTGGTGTTGATGACAAATCATTCAACCAATCAGCTTGGGAAGGTTTGCAGGCTTGGGGTAAAGA
ACACAATCTTTCAAAAGATAACGGTTTCACTTACTTCCAATCAACAAGTGAAGCTGACTACGCTAACAA
CTTGCAACAAGCGGCTGGAAGTTACAACCTAATCTTCGGTGTTGGTTTTGCCCTTAATAATGCAGTTAA
AGATGCAGCAAAAGAACACACTGACTTGAACTATGTCTTGATTGATGTGATTAAAGACCAAAAGAA
TGTTGCGAGCGTAACTTTCGCTGATAATGAGTCAGGTTACCTTGCAGGTGTGGCTGCAGCAAAAACAAC
TAAGACAAAACAAGATGGTTTTGTAGGTGGTATCGAATCTGAAGTTATCTCTCGTTTTGAAGCAGGATT
CAAGGCTGGTGTTGCGTCAGTAGACCCCATCTATCAAAGTCCAAGTTGACTACGCTGGTTCATTTGGTGA
TGCGGCTAAAGGTAAAACAATTGCAGCCGCACAATACGCAGCCGGTGCAGATATTGTTTACCAAGTAGC
TGGTGGTACAGGTGCAGGTGTCTTTGCAGAGGCAAAATCTCTCAACGAAAGCCGTCCTGAAAATGAAAA
AGTTTGGGTTATCGGTGTTGATCGTGACCAAGAAGCAGAAGGTAAATACACTTCTAAAGATGGCAAAGA
ATCAAACTTTGTTCTTGTATCTACTTTGAAACAAGTTGGTACAACTGTAAAAGATATTTCTAACAAGGC
AGAAAGAGGAGAATTCCCTGGCGGTCAAGTGATCGTTTACTCATTGAAGGATAAAGGGGTTGACTTGGC
AGTAACAAACCTTTCAGAAGAAGGTAAAAAAGCTGTCGAAGATGCAAAAGCTAAAATCCTTGATGGAAG
CGTAAAAGTTCCTGAAAAA SP007 amino acid (SEQ ID NO:8)
GNRSSRNAASSSDVKTKAAIVTDTGGVDDKSFNQSAWEGLQAWGKEHNLSKDNGFTYFQSTSEADYANN
LQQAAGSYNLIFGVGFALNNAVKDAAKEHTDLNYVLIDDVIKDQKNVASVTFADNESGYLAGVAAAKTT
KTKQVGFVGGIESEVISRFEAGFKAGVASVDPSIKVQVDYAGSFGDAAKGKTIAAAQYAAGADIVYQVA
GGTGAGVFAEAKSLNESRPENEKVWVIGVDRDQEAEGKYTSKDGKESNFVLVSTLKQVGTTVKDISNKA
ERGEFPGGQVIVYSLKDKGVDLAVTNLSEEGKKAVEDAKAKILDGSVKVPEK SP008 nucleotide (SEQ ID NO:9)
TGTGGAAATTTGACAGGTAACAGCAAAAAAGCTGCTGATTCAGGTGACAAACCTGTTATCAAAATGTAC
CAAATCGGTGACAAACCAGACAACTTGGATGAATTGTTAGCAAATGCCAACAAAATCATTGAAGAAAAA
GTTGGTGCCAAATTGGATATCCAATACCTTGGCTGGGGTGACTATGGTAAGAAAATGTCAGTTATCACA
TCATCTGGTGAAAACTATGATATTGCCTTTGCAGATAACTATATTGTAAATGCTCAAAAAGGTGCTTAC
GCTGACTTGACAGAATTGTACAAAAAAGAAGGTAAAGACCTTTACAAAGCACTTGACCCAGCTTACATC
AAGGGTAATACTGTAAATGGTAAGATTTACGCTGTTCCAGTTGCAGCCAACGTTGCATCATCTCAAAAC
TTTGCCTTCAACGGAACTCTCCTTGCTAAATATGGTATCGATATTTCAGGTGTTACTTCTTACGAAACT
CTTGAGCCAGTCTTGAAACAAATCAAAGAAAAAGCTCCAGACGTAGTACCATTTGCTATTGGTAAAGTT
TTCATCCCATCTGATAATTTTGACTACCCAGTAGCAAACGGTCTTCCATTCGTTATCGACCTTGAAGGC
GATACTACTAAAGTTGTAAACCGTTACGAAGTGCCTCGTTTCAAAGAACACTTGAAGACTCTTCACAAA
TTCTATGAAGCTGGGTACATTCCAAAAGACGTCGCAACAAGCGATACTTCCTTTGACCTTCAACAAGAT
ACTTGGTTCGTTCGTGAAGAAACAGTAGGACCAGCTGACTACGGTAACAGCTTGCTTTCACGTGTTGCC
AACAAAGATATCCAAATCAAACCAATTACTAACTTCATCAAGAACAAACCAAACAACACAAGTTGCTAAC
TTTGTCATCTCAAACAACTCTAAGAACAAAGAAAAATCAATGGAAATCTTGAACCTCTTGAATACGAAC
CCAGAACTCTTGAACGGTCTTGTTTACGGTCCAGAAGGCAAGAACTGGGAAAAAATTGAAGGTAAAGAA
AACCGTGTTCGCGTTCTTGATGGCTACAAAGGAAACACTCACATGGGTGGATGGAACACTGGTAACAAC
TGGATCCTTTACATCAACGAAAACGTTACAGACCAACAAATCGAAAATTCTAAGAAAGAATTGGCAGAA
GCTAAAGAATCTCCAGCGCTTGGATTTATCTTCAATACTGACAATGGCAAATCTGAAATCTCAGCTATT
GCTAACACAATGCAACAATTTGATACAGCTATCAACACTGGTACTGTAGACCCAGATAAAGCGATTCCA
GAATTGATGGAAAAATTGAAATCTGAAGGTGCCTACGAAAAAGTATTGAACGAAATGCAAAAACAATAC
GATGAATTCTTGAAAAACAAAAA SP008 amino acid (SEQ ID NO:10)
CGNLTGNSKKAADSGDKPVIKMYQIGDKPDNLDELLANANKIIEEKVGAKLDIQYLGWGDYGKKMSVIT
SSGENYDIAFADNYIVVAQKGAYADLTELYKKEGKDLYKALDPAYIKGNTVNGKIYAVPVAANVASSQN
FAFNGTLLAKYGIDISGVTSYETLEPVLKQIKEKAPDVVPFAIGKVFIPSDNFDYPVANGLPFVIDLEG
DTTKVVNRYEVPRFKEHLKTLHKFYEAGYIPKDVATSDTSFDLQQDTWFVREETVGPADYGNSLLSRVA
NKDIQIKPITNFIKXNQTTQVANFVISNNSKNKEKSMEILNLLNTNPELLNGLVYGPEGKNWEKIEGKE
NRVRVLDGYKGNTHMGGWNTGNNWILYINENVTDQQIENSKKELAEAKESPALGFIFNTDNVKSEISAI
ANTMQQFDTAINTGTVDPDKAIPELMEKLKSEGAYEKVLNEMQKQYDEFLKNKK SP009 nucleotide (SEQ ID NO:11)
TGGTCAAGGAACTGCTTCTAAAGACAACAAAGAGGCAGAACTTAAGAAGGTTGACTTTATCCTAGACTG
GACACCAAATAGCAACCACACAGGGCTTTATGTTGCCAAGGAAAAAGGTTATTTCAAAGAAGCTGGAGT
GGATGTTGATTTGAAATTGCCACCAGAAGAAAGTTCTTCTGACTTGGTTATCAACGGAAAGGCACCATT
TGCAGTGTATTTCCAAGACTACATGGCTAAGAATTGGAAAAAGGAGCAGGAATCACTGCCCTTGCAGC
TATTGTTGAACACAATACATCAGGAATCATCTCTCGTAAATCTGATAATGTAAGCAGTCCAAAAGACTT
GGTTGGTAAGAAATATGGGACATGGAATGACCCAACTGAACTTGCTATGTTGAAAACCTTGGTAGAATC
TCAAGGTGGAGACTTTGAGAAGGTTGAAAAAGTACCAAATAACGACTCAAACTCAATCACACCGATTGC
CAATGGCGTCTTTGATACTGCTTGGATTTACTACGGTTGGGATGGTATCCTTGCTAAATCTCAAGGTGT
AGATGCTAACTTCATGTACTTGAAAGACTATGTCAAGGAGTTTGACTACTATTCACCAGTTATCATCGC
AAACAACGACTATCTGAAAGATAACAAAGAAGAAGCTCGCAAAGTCATCCAAGCCATCAAAAAGGCTA
CCAATATGCCATGGAACATCCAGAAGAAGCTGCAGATATTCTCATCAAGAATGCCACCTGAACTCAAGGA
AAAACGTGACTTTGTCATCGAATCTCAAAAATACTTGTCAAAAGAATACGCAAGCGACAAGGAAAAATG
GGGTCAATTTGACGCAGCTCGCTGGAATGCTTTCTACAAATGGGATAAAGAAAATGGTATCCTTAAAGA
AGACTTGACAGACAAAGGCTTCACCAACGAATTTGTGAAA TABLE 1-continued SP009 amino acid (SEQ ID NO:12)
GQGTASKDNKEAELKKVDFILDWTPNTNHTGLYVAKEKGYFKEAGVDVDLKLPPEESSSDLVINGKAPF
AVYFQDYMAKKLEKGAGITAVAAIVEHNTSGIISRKSDNVSSPKDLVGKKYGTWNDPTELAMLKTLVES
QGGDFEKVEKVPNNDSNSITPIANGVFDTAWIYYGWDGILAKSQGVDANFMYLKDYVKEFDYYSPVIIA
NNDYLKDNKEEARKVIQAIKKGYQYAMEHPEEAADILIKNAPELKEKRDFVIESQKYLSKEYASDKEKW
GQFDAARWNAFYKWDKENGILKEDLTDKGFTNEFVK SP010 nucleotide (SEQ ID NO:13)
TAGCTCAGGTGAAAACGCTGGTTCATCCTCTGGAAAAACAACTGCCAAAGCTCGCACTATCGATGAAAT
CAAAAAAAGCGGTGAACTGCGAATCGCCGTGTTTGGAGATAAAAAACCGTTTGGCTACGTTGACAATGA
TGGTTCTACCAAGGTACGCTACGATATTGAACTAGGGAACCAACTAGCTCAAGACCTTGGTGTCAAGGT
TAAATACATTTCAGTCGATGCTGCCAACCGTGCGGAATACTTGATTTCAAACAAGGTAGATATTACTCT
TGCTAACTTTACAGTAACTGACGAACGTAAGAAACAAGTTGATTTTGCCCTTCCATATATGAAAGTTTC
TCTGGGTGTCGTATCACCTAAGACTGGTCTCATTACAGACGTCAAACAACTTGAAGGTAAAACCTTAAT
TGTCACAAAAGGAACGACTGCTGAGACTTATTTTGAAAAGAATCATCCAGAAATCAAACTCCAAAAATA
CGACCAATACAGTGACTCTTACCAAGCTCTTCTTGACGGACGTGGAGATGCCTTTTCAACTGACAATAC
GGAAGTTCTAGCTTGGGCGCTTGAAAATAAAGGATTTGAAGTAGGAATTACTTCCCTCGGTGATCCCGA
TACCATTGCGGCAGCAGTTCAAAAAGGCAACCAAGAATTGCTAGACTTCATCAATAAAGATATTGAAAA
ATTAGGCAAGGAAAACTTCTTCCACAAGGCCTATGAAAAGACACTTCACCCAACCTACGGTGACGCTGC
TAAAGCAGATGACCTGGTTGTTGAAGGTGGAAAAGTTGAT SP010 amino acid (SEQ ID NO:14)
SSGGNAGSSSGKTTAKARTIDEIKKSGELRIAVFGDKKPFGYVDNDGSTKVRYDIELGNQLAQDLGVKV
KYISVDAANRAEYLISNKVDITLANFTVTDERKKQVDFALPYMKVSLGVVSPKTGLITDVKQLEGKTLI
VTKGTTAETYFEKNHPEIKLQKYDQYSDSYQALLDGRGDAFSTDNTEVLAWALENKGFEVGITSLGDPD
TIAAAVQKGNQELLDFINKDIEKLGKENFFHKAYEKTLHPTYGDAAKADDLVVEGGKVD SP011 nucleotide (SEQ ID NO:15)
CTCCAACTATGGTAAATCTGCGGATGGCACAGTGACCATCGAGTATTTCAACCAGAAAAAAGAAATGAC
CAAAACCTTGGAAGAAATCACTCGTGATTTTGAGAAGGAAAACCCTAAGATCAAGGTCAAAGTCGTCAA
TGTACCAAATGCTGGTGAAGTATTGAAGACACGCGTTCTCGCAGGAGATGTGCCTGATGTGGTCAATAT
TTACCCACAGTCCATCGAACTGCAAGAATGGGCAAAAGCAGGTGTTTTTGAAGATTTGAGCAACAAAGA
CTACCTGAAACGCGTGAAAAATGGCTACGCTGAAAAATATGCTGTAAACGAAAAAGTTTACAACGTTCC
TTTTTACAGCTAATGCTTATGGAATTTACTACAACAAAGATAAATTCGAAGAACTGGGCTTGAAGGTTCC
TGAAACCTGGGATGAATTTGAACAGTTAGTCAAAGATATCGTTGCTAAAGGACAAACACCATTTGGAAT
TGCAGGTGCAGATGCTTGGACACTCAATGGTTACAATCAATTAGCCTTTGCGACAGCAACAGGTGGAGG
AAAAGAAGCAAATCAATACCTTCGTTATTCTCAACCAAATGCCATTAAATTGTCGGATCCGATTATGAA
AGATGATATCAAGGTCATGGACATCCTTCGCATCAATGGATCTAAGCAAAAGAACTGGGAAGGTGCTGG
CTATACCGATGTTATCGGAGCCTTCGCACGTGGGGATGTCCTCATGACACCAAATGGGTCTTGGGCGAT
CACAGCGATTAATGAACAAAAACCGAACTTTAAGATTGGGACCTTCATGATTCCAGGAAAAGAAAAAGG
ACAAAGCTTAACCGTTGGTGCGGGAGACTTGGCATGGTCTATCTCAGCCACCACCAAACATCCAAAAGA
AGCCAATGCCTTTGTGGAATATATGACCCGTCCAGAAGTCATGCAAAAATACTACGATGTGGACGGATC
TCCAACAGCGATCGAAGGGGTCAAACAAGCAGGAGAAGATTCACCGCTTGCTGGTATGACCGAATATGC
CTTTACGGATCGTCACTTGGTCTGGTTGCAACAATACTGGACCAGTGAAGCAGACTTCCATACCTTGAC
CATGAACTATGTCTTGACCGGTGATAAACAAGGCATGGTCAATGATTTGAATGCCTTCTTTAACCCGAT
GAAAGCGGATGTGGAT SP011 amino acid (SEQ ID NO:16)
SNYGKSADGTVTIEYFNQKKEMTKTLEEITRDFEKENPKIKVKVVNVPNAGEVLKTRVLAGDVPDVVNI
YPQSIELQEWAKAGVFEDLSNKDYLKRVKNGYAEKYAVNEKVYNVPFTANAYGIYYNKDKFEELGLKVP
ETWDEFEQLVKDIVAKGQTPFGIAGADAWTLNGYNQLAFATATGGGKEANQYLRYSQPNAIKLSDPIMK
DDIKVMDILRINGSKQKNWEGAGYTDVIGAFARGDVLMTPNGSWAITAINEQKPNFKIGTFMIPGKEKG
QSLTVGAGDLAWSISATTKHPKEANAFVEYMTRPEVMQKYYDVDGSPTAIEGVKQAGEDSPLAGMTEYA
FTDRHLVWLQQYWTSEADFHTLTMNYVLTGDKQGMVNDLNAFFNPMKADVD SP012 nucleotide (SEQ ID NO:17)
TGGGAAAAATTCTAGCGAAACTAGTGGAGATAATTGGTCAAAGTACCAGTCTAACAAGTCTATTACTAT
TGGATTTGATAGTACTTTTGTTCCAATGGGATTTGCTCAGAAAGATGGTTCTTATGCAGGATTTGATAT
TGATTTAGCTACAGCTGTTTTTGAAAAATACGGAATCACGGTAAATTGGCAACCGATTGATTGGGATTT
GAAAGAAGCTGAATTGACAAAAGGAACGATTGATCTGATTTGGAATGCTATTCCGCTACGACGAACG
CCGTGAAAAGGTGGCTTTCAGTAACTCATATATGAAGAATGAGCAGGTATTGGTTACGAAGAAATCATC
TGGTATCACGACTGCAAAGGATATGACTGGAAAGACATTAGGAGCTCAAGCTGGTTCATCTGGTTATGC
GGACTTTGAAGCAAATCCAGAAATTTTGAAGAATATTGTCGCTAATAAGGAAGCGAATCAATACCAAAC
CTTTAATGAAGCCTTGATTGATTTGAAAAACGATCGAATTGATGGTCTATTGATTGACCGTGTCTATGC
AAACTATTATTTAGAAGCAGAAGGTGTTTTAAACGATTATAATGTCTTTACAGTTGGACTAGAAACAGA
AGCTTTTGCGGTTGGAGCCCGTAAGGAAGATACAAACTTGGTTAAGAAGATAAATGAAGCTTTTTCTAG
TCTTTACAAGGACGGCAAGTTCCAAGAAATCAGCCAAAAATGGTTTGGAGAAGATGTAGCAACCAAAGA
AGTAAAAGAAGGACAG SP012 nucleotide (SEQ ID NO:18)
GKNSSETSGDNWSKYQSNKSITIGFDSTFVPMGFAQKDGSYAGFDIDLATAVFEKYGITVNWQPIDWDL
KEAELTKGTIDLIWNGYSATDERREKVAFSNSYMKNEQVLVTKKSSGITTAKDMTGKTLGAQAGSSGYA
DFEANPEILKNIVANKEANQYQTFNEALIDLKNDRIDGLLIDRVYANYYLEAEGVLNDYNVFTVGLETE
AFAVGAREDTNLVKKINEAFSSLYKDGKFQEISQKWFGEDVATKEVKEGQ SP013 nucleotide (SEQ ID NO:19)
TGCTAGCGGAAAAAAGATACAACTTCTGGTCAAAAACTAAAAGTTGTTGCTACAAACTCAATCATCGC
TGATATTACTAAAAATATTGCTGGTGACAAAATTGACCTTCATAGTATCGTTCCGATTGGGCAAGACCC
ACACGAATACGAACCACTTCCTGAAGACGTTAAGAAAACTTCTGAGGCTAATTTGATTTTCTATAACGG TABLE 1-continued

```
TATCAACCTTGAAACAGGTGGCAATGCTTGGTTTACAAAATTGGTAGAAAATGCCAAGAAAACTGAAAA
CAAAGACTACTTCGCAGTCAGCGACGGCGTTGATGTTATCTACCTTGAAGGTGAAAATGAAAAAGGAAA
AGAAGACCCACACGCTTGGCTTAACCTTGAAAACGGTATTATTTTTGCTAAAAATATCGCCAAACAATT
GAGCGCCAAAGACCCTAACAATAAAGAATTCTATGAAAAAAATCTCAAAGAATATACTGATAAGTTAGA
CAAACTTGATAAAGAAAGTAAGGATAAATTTAATAAGATCCCTGCTGAAAAGAAACTCATTGTAACCAG
CGAAGGAGCATTCAAATACTTCTCTAAAGCCTATGGTGTCCCAAGTGCTTACATCTGGGAAATCAATAC
TGAAGAAGAAGGAACTCCTGAACAAATCAAGACCTTGGTTGAAAAACTTCGCCAAACAAAAGTTCCATC
ACTCTTTGTAGAATCAAGTGTGGATGACCGTCCAATGAAAACTGTTTCTCAAGACACAAACATCCCAAT
CTACGCTCAAATCTTTACTGACTCTATCGCAGAACAAGGTAAAGAAGGCGACAGCTACTACAGCATGAT
GAAATACAACCTTGACAAGATTGCTGAAGGATTGGCAAAA

SP013 amino acid (SEQ ID NO:20)
ASGKKDTTSGQKLKVVATNSIIADITKNIAGDKIDLHSIVPIGQDPHEYEPLPEDVKKTSEANLIFYNG
INLETGGNAWFTKLVENAKKTENKDYFAVSDGVDVIYLEGQNEKGKEDPHAWLNLENGIIFAKNIAKQL
SAKDPNNKEFYEKNLKEYTDKLDKLDKESKDKFNKIPAEKKLIVTSEGAFKYFSKAYGVPSAYIWEINT
EEEGTPEQIKTLVEKLRQTKVPSLFVESSVDDRPMKTVSQDTNIPIYAQIFTDSIAEQGKEGDSYYSMM
KYNLDKIAEGLAK SP014 nucleotide (SEQ ID NO:21)
TGGCTCAAAAAATACAGCTTCAAGTCCAGATTATAAGTTGGAAGGTGTAACATTCCCGCTTCAAGAAAA
GAAAACATTGAAGTTTATGACAGCCAGTTCACCGTTATCTCCTAAAGACCCAAATGAAAAGTTAATTTT
GCAACGTTTGGAGAAGGAAACTGGCGTTCATATTGACTGGACCAACTACCAATCCGACTTTGCAGAAAA
ACGTAACTTGGATATTTCTAGTGGTGATTTACCAGATGCTATCCACAACGACGGAGCTTCAGATGTGGA
CTTGATGAACTGGGCTAAAAAAGGTGTTATTATTCCAGTTGAAGATTTGATTGATAAATACATGCCAAA
TCTTAAGAAAATTTTGGATGAGAAACCAGAGTACAAGGCCTTGATGACAGCAGCTGATGGGCACATTTA
CTCATTTCCATGGATTGAAGAGCTTGGAGATGGTAAAGAGTCTATTCACAGTGTCAACGATATGGCTTG
GATTAACAAAGATTGGCTTAAGAAACTTGGTCTTGAAATGCCAAAAACTACTGATGATTTGATTAAAGT
CCTAGAAGCTTTCAAAAACGGGGATCCAAATGGAAATGGAGAGGCTGATGAAATTCCATTTTCATTTAT
TAGTGGTAACGGAAACGAAGATTTTAAATTCCTATTTGCTGCATTTGGTATAGGGGATAACGATGATCA
TTTAGTAGTAGGAAATGATGGCAAAGTTGACTTCACAGCAGATAACGATAACTATAAAGAAGGTGTCAA
ATTTTATCCGTCAATTGCAAGAAAAAGGCCTGATTGATAAAGAAGCTTTCGAACATGATTGGAATAGTTA
CATTGCTAAAGGTCATGATCAGAAATTTGGTGTTTACTTTACATGGGATAAGAATAATGTTACTGGAAG
TAACGAAAGTTATGATGTTTTACCAGTACTTGCTGGACCAAGTGGTCAAAAACACGTAGCTGCTAACAA
CGGTATGGGATTTGCACGTGACAAGATGGTTATTACCAGTGTAAACAAAAACCTAGAATTGACAGCTAA
ATGGATTGATGCACAATACGCTCCACTCCAATCTGTGCAAAATAACTGGGGAACTTACGGAGATGACAA
ACAACAAAACATCTTTGAATTGGATCAAGCGTCAAATAGTCTAAAACACTTACCACTAAACGGAACTGC
ACCAGCAGAACTTCGTCAAAAGACTGAAGTAGGAGGAGCACTAGCTATCCTAGATTCATACTATGGTAA
AGTAACAACCATGCCTGATGATGCCAAATGGCGTTTGGATCTTATCAAAGAATATTATGTTCCTTACAT
GAGCAATGTCAATAACTATCCAAGAGTCTTTATGACACAGGAAGATTTGGACAAGATTGCCCATATCGA
AGCAGATATGAATGACTATATCTACCGTAAACGTGCTGAATGGATTGTAAATGGCAATATTGATACTGA
GTGGGATGATTACAAGAAGAACTTGAAAAATACGGACTTTCTGATTACCTCGCTATTAAACAAAAATA
CTACGACCAATACCAAGCAAACAAAAAC SP014 amino acid (SEQ ID NO:22)
GSKNTASSPDYKLEGVTFPLQEKKTLKFMTASSPLSPKDPNEKLILQRLEKETGVHIDWTNYQSDFAEK
RNLDISSGDLPDAIHNDGASDVDLMNWAKKGVIIPVEDLIDKYMPNLKKILDEKPEYKALMTAPDGHIY
SFPWIEELGDGKESIHSVNDMAWINKDWLKKLGLEMPKTTDDLIKVLEAFKNGDPNGNGEADEIPFSFI
SGNGNEDFKFLFAAFGIGDNDDHLVVGNDGKVDFTADNDNYKEGVKFIPQLQEKGLIDKEAFEHDWNSY
IAKGHDQKFGVYFTWDKNNVTGSNESYDVLPVLAGPSGQKHVARTNGMGFARDKMVITSVNKNLELTAK
WIDAQYAPLQSVQNNWGTYGDDKQQNIFELDQASNSLKHLPLNGTAPAELRQKTEVGGPLAILDSYYGK
VTTMPDDAKWRLDLIKEYYVPYMSNVNNYPRVFMTQEDLDKIAHIEADMNDYIYRKRAEWIVNGNIDTE
WDDYKKELEKYGLSDYLAIKQKYYDQYQANKN SP015 nucleotide (SEQ ID NO:23)
TAGTACAAACTCAAGCACTAGTCAGACAGAGACCAGTAGCTCTGCTCCAACAGAGGTAACCATTAAAAG
TTCACTGGACGAGGTCAAACTTTCCAAAGTTCCTGAAAAGATTGTGACCTTTGACCTCGGCGCTGCGGA
TACTATTCGCGCTTTAGGATTTGAAAAAAATATCGTCGGAATGCCTACAAAAACTGTTCCGACTTATCT
AAAAGACCTAGTGGGAACTGTCAAAAATGTTGGTTCTATGAAAGAACCTGATTTAGAAGCTATCGCCGC
CCTTGAGCCTGATTTGATTATCGCTTCGCCACGTACACAAAAATTCGTAGACAAATTCAAAGAAATCGC
CCCAACCGTTCTCTTCCAAGCAAGCAAGGACGACTACTGGACTTCTACCAAGGCTAATATCGAATCCTT
AGCAAGTGCCTTCGGCGAAACTGGTACACAGAAAGCCAAGGAAGAATTGACCAAGCTAGACAAGAGCAT
CCAAGAAGTCGCTACTAAAAATGAAAGCTCTGACAAAAAAGCCCTTGCGATCCTCCTTAATGAAGGAAA
AATGGCAGCCTTTGCTGGCAAATCTCGTTTCTCTTTCTTGTACCAAACCTTGAAATTCAAACCAACTGA
TACAAAATTTGAAGACTCACGCCACGGACAAGAAGTCAGCTTTGAAAGTGTCAAAGAAATCAACCCTGA
CATCCTCTTTGTCATCAACCGTACCCTTGCCATCGGTGGGGCAACTCTAGCAACGACGGTGTCCTAGA
AAATGCCCTTATCGCTGAAACACCTGCTGCTAAAAATGGTAAGATTATCCAACTAACACCAGACCTCTG
GTATCTAAGCGGAGGCGGACTTGAATCAACAAAACTCATGATTGAAGACATACAAAAAGCTTTGAAA SP015 amino acid (SEQ ID NO:24)
STNSSTSQTETSSSAPTEVTIKSSLDEVKLSKVPEKIVTFDLGAADTIRALGFEKNIVGMPTKTVPTYL
KDLVGTVKNVGSMKEPDLEAIAALEPDLIIASPRTQKFVDKFKEIAPTVLFQASKDDYWTSTKANIESL
ASAFGETGTQKAKEELTKLDKSIQEVATKNESSDKKALAILLNEGKMAAFGAKSKFSFLYQTLKFKPTD
TKFEDSRHGQEVSFESVKEINPDILFVINRTLAIGGDNSSNDGVLENALIAETPAAKNGKIIQLTPDLW
YLSGGGLESTKLMIEDIQKALK SP016 nucleotide (SEQ ID NO:25)
TGGCAATTCTGGCGGAAGTAAAGATGCTGCCAAATCAGGTGGTGACGGTGCCAAAACAGAAATCACTTG
GTGGGCATTCCCAGTATTTACCCAAGAAAAAACTGGTGACGGTGTTGGAACTTATCAAAAATCAATCAT
CGAAGCGTTTGAAAAAGCAAACCCAGATATAAAAGTGAAATTGGAAACCATCGACTTCAAGTCAGGTCC
```

TABLE 1-continued

```
TGAAAAAATCACAACAGCCATCGAAGCAGGAACAGCTCCAGACGTACTCTTTGATGCACCAGGACGTAT
CATCCAATACGGTAAAAACGGTAAATTGGCTGAGTTGAATGACCTCTTCACAGATCAATTTGTTAAAGA
TGTCAACAATGAAAACATCGTACAAGCAAGTAAAGCTGGAGACAAGGCTTATATGTATCCGATTAGTTC
TGCCCCATTCTACATGGCAATGACAAGAAAATGTTAGAAGATGCTGGAGTAGCAAACCTTGTAAAAGA
AGGTTGGACAACTGATGATTTTGAAAAAGTATTGAAAGCACTTAAAGACAAGGGTTACACACCAGGTTC
ATTGTTCAGTTCTGGTCAAGGGGGAGACCAAGGAACACGTGCCTTTATCTCTAACCTTTATAGCGGTTC
TGTAACAGATGAAAAAGTTAGCAAATATACAACTGATGATCCTAAATTCGTCAAAGGTCTTGAAAAAGC
AACTAGCTGGATTAAAGACAATTTGATCAATAATGGTTCACAATTTGACGGTGGGGCAGATATCCAAA
CTTTGCCAACGGTCAAACATCTTACACAATCCTTTGGGCACCAGCTCAAAATGGTATGCAAGCTAAACT
TTTAGAAGCAAGTAAGGTAGAAGTGGTAGAAGTACCATTCCCATCAGACGAAGGTAAGCCAGCTCTTGA
GTACCTTGTAAACGGGTTTGCAGTATTCAACAATAAAGACGACAAGAAAGTCGCTGCATCTAAGAAATT
CATCCAGTTTATCGCAGATGACAAGGAGTGGGGACCTAAAGACGTAGTTCGTACAGGTGCTTTCCCAGT
CCGTACTTCATTTGGAAAACTTTATGAAGACAAACGCATGGAAACAATCAGCGGCTGGACTCAATACTA
CTCACCATACTACAACACTATTGATGGATTTGCTGAAATGAGAACACTTTGGTTCCCAATGTTGCAATC
TGTATCAAATGGTGACGAAAAACCAGCAGATGCTTTGAAAGCCTTCACTGAAAAAGCGAACGAAACAAT
CAAAAAAGCTATGAAACAA

SP016 amino acid (SEQ ID NO:26)
GNSGGGSKDAAKSGGDGAKTEITWWAFPVFTQEKTGDGVGTYEKSIIEAFEKANPDIKVKLETIDFKSGP
EKITTAIEAGTAPDVLFDAPGRIIQYGKNGKLAELNDLFTDEFVKDVNNENIVQASKAGDKAYMYPISS
APFYMAMNKKMLEDAGVANLVKEGWTTDDFEKVLKALKDKGYTPGSLFSSGQGGDQGTRAFISNLYSGS
VTDEKVSKYTTDDPKFVKGLEKATSWIKDNLINNGSQFDGGADIQNFANGQTSYTILWAPAQNGIQAKL
LEASKVEVVEVPFPSDEGKPALEYLVNGFAVFNNKDDKKVAASKKFIQFIADDKEWGPKDVVRTGAFPV
RTSFGKLYEDKRMETISGWTQYYSPYYNTIDGFAEMRTLWFPMLQSVSNGDEKPADALKAFTEKANETI
KKAMKQ SP017 nucleotide (SEQ ID NO:27)
TTCACAAGAAAAAACAAAAAATGAAGATGGAGAAACTAAGACAGAACAGACAGCCAAAGCTGATGGAAC
AGTCGGTAGTAAGTCTCAAGGAGCTGCCCAGAAGAAAGCAGAAGTGGTCAATAAAGGTGATTACTACAG
CATTCAAGGGAAATACGATGAAATCATCGTAGCCAACAAACACTATCCATTGTCTAAAGACTATAATCC
AGGGGAAAATCCAACAGCCAAGGCAGAGTTGGTCAAACTCATCAAAGCGATGCAAGAGGCAGGTTTCCC
TATTAGTGATCATTACAGTGGTTTTAGAAGTTATGAAACTCAGACCAAGCTCTATCAAGATTATGTCAA
CCAAGATGGAAAGGCAGCAGCTGACCGTTACTCTGCCCGTCCTGGCTATAGCGAACACCAGACAGGCTT
GGCCTTTGATGTGATTGGGACTGATGGTGATTTGGTGACAGAAGAAAAAGCAGCCCAATGGCTCTTGGA
TCATGCAGCTGATTATGGCTTTGTTGTCCGTTATCTCAAAGGCAAGGAAAAGGAAACAGGCTATATGGC
TGAAGAATGGCACCTGCGTTATGTAGGAAAAGAAGCTAAAGAAATTGCTGCAAGTGGTCTCAGTTTGGA
AGAATACTATGGCTTTGAAGGCGGAGACTACGTCGAT SP017 amino acid (SEQ ID NO:28)
SQEKTKNEDGETKTEQTAKADGTVGSKSQGAAQKKAEVVNKGDYYSIQGKYDEIIVANKHYPLSKDYNP
GENPTAKAELVKLIKAMQEAGFPISDHYSGFRSYETQTKLYQDYVNQDGKAAADRYSARPGYSEHQTGL
AFDVIGTDGDLVTEEKAAQWLLDHAADYGFVVRYLKGKEKETGYMAEEWHLRYVGKEAKEIAASGLSLE
EYYGFEGGDYVD SP019 nucleotide (SEQ ID NO:29)
GAAAGGTCTGTGGTCAAATAATCTTACCTGCGGTTATGATGAAAAAATAATCTTGGAAAATATAAATAT
AAAAATACCTGAAGAAAAAATATCAGTTATTATTGGGTCAAATGGTTGTGGGAAATCAACACTCATTAA
AACCCTTGTCTCGACTTATAAAGCCATTAGAGGGAGAAGTATTGCTTGATAATAAATCAATTAATTCTTA
TAAAGAAAAAGATTTAGCAAAACACATAGCTATATTACCTCAATCTCCAATAATCCCTGAATCAATAAC
AGTAGCTGATCTTGTAAGCCGTGGTCGTTTCCCCTACAGAAAGGCTTTTAACAGTCTTGGAAAAGATGA
CCTTGAAATAATAAACAGATCAATGGTTAAGGCCAATGTTGAAGATCTAGCAAATAACCTAGTTGAAGA
ACTTTCTGGGGGTCAAAGGCAAAGAGTATGGATAGCTCTAGCCCTAGCCCAAGATACAAGTATCCTACT
TTTAGATGAGCCAACTACTTACTTGGATATCTCATATCAAATAGAACTATTAGACCTCTTGACTGATCT
AAACCAAAAATATAAGACAACCATTTGCATGATTTTGCACGATATAAATCTAACAGCAAGATACGCTGA
TTACCTATTTGCAATTAAAGAAGGTAAACTTGTTGCAGAGGGAAAGCCTGAAGATATACTAAATGATAA
ACTAGTTAAAGATATCTTTAATCTTGAAGCAAAAATTATACGTGACCCTATTTCCAATTCGCCTCTAAT
GATTCCTATTGGCAAGCACCATGTTAACTCT SP019 amino acid (SEQ ID NO:30)
KGLWSNNLTCGYDEKIILENINIKIPEEKISVIIGSNGCGKSTLIKTLSRLIKPLEGEVLLDNKSINSY
KEKDLAKHIAILPQSPIIPESITVADLVSRGRFPYRKPFKSLGKDDLEIINRSMVKANVEDLANNLVEE
LSGGQRQRVWIALALAQDTSILLLDEPTTYLDISYQIELLDLLTDLNQKYKTTICMILHDINLTARYAD
YLFAIKEGKLVAEGKPEDILNDKLVKDIFNLEAKIIRDPISNSPLMIPIGKHHVS SP020 nucleotide (SEQ ID NO:31)
AAACTCAGAAAAGAAAGCAGACAATGCAACAACTATCAAAATCGCAACTGTTAACCGTAGCGGTTCTGA
AGAAAAAACGTTGGGACAAAATCCAAGAATTGGTTAAAAAAGACGGAATTACCTTGGAATTTACAGAGTT
CACAGACTACTCACAACCAAACAAAGCAACTGCTGATGGCGAAGTAGATTTGAACGCTTTCCAACACTA
TAACTTCTTGAACAACTGGAACAAAGAAAACGGAAAAGACCTTGTAGCGATTGCAGATACTTACATCTC
TCCAATCCGGCTTTACTCAGGTTTGAATGGAAGTGCCAACAAGTACACTAAAGTAGAAGACATCCCAGC
AAACGGAGAAATCGCTGTACCGAATGACGCTACAAACGAAAGGCGTGCGCTTTATTGCTTCAATCAGC
TGGCTTGATTAATTGGATGTTTCTGGAACTGCTCTTGCAACAGTTGCCAACATCAAAGAAAATCCAAA
GAACTTGAAAATCACTGAATTGGACGCTAGCCAAACAGCTCGTTCATTGTCATCAGTTGACGCTGCCGT
TGTAAACAATACCTCGTTACAGAAGCAAAATTGGACTACAAGAAATCACTTTTCAAAGAACAAGCTGA
TGAAAACTCAAAACAATGGTACAACATCATTGTTGCAAAAAAAAGATTGGGAAACATCACCTAAGGCTGA
TGCTATCAAGAAGTAATCGCAGCTTACCACACAGATGACGTGAAAAAAGTTATCGAAGAATCATCAGA
TGGTTTGGATCAACCAGTTTGG SP020 amino acid (SEQ ID NO:32)
```

TABLE 1-continued

NSEKKADNATTIKIATVNRSGSEEKRWDKIQELVKKDGITLEFTEFTDYSQPNKATADGEVDLNAFQHY
NFLNNWNKENGKDLVAIADTYISPIRLYSGLNGSANKYTKVEDIPANGEIAVPNDATNESRALYLLQSA
GLIKLDVSGTALATVANIKENPKNLKITELDASQTARSLSSVDAAVVNNTFVTEAKLDYKKSLFKEQAD
ENSKQWYNIIVAKKDWETSPKADAIKKVIAAYHTDDVKKVIEESSDGLDQPVW

SP021 nucleotide (SEQ ID NO:33)
TTCGAAAGGGTCAGAAGGTGCAGACCTTATCAGCATGAAAGGGGATGTCATTACAGAACATCAATTTTA
TGAGCAAGTGAAAAGCAACCCTTCAGCCCAACAAGTCTTGTTAAATATGACCATCCAAAAAGTTTTTGA
AAAACAATATGGCTCAGAGCTTGATGATAAAGAGGTTGATGATACTATTGCCGAAGAAAAAAAACAATA
TGGCGAAAACTACCAACGTGTCTTGTCACAAGCAGGTATGACTCTTGAAACACGTAAAGCTCAAATTCG
TACAAGTAAATTAGTTGAGTTGGCAGTTAAGAAGGTAGCAGAAGCTGAATTGACAGATGAAGCCTATAA
GAAAGCCTTTGATGAGTACACTCCAGATGTAACGGCTCAAATCATCCGTCTTAATAATGAAGATAAGGC
CAAAGAAGTTCTCGAAAAAGCCAAGGCAGAAGGTGCTGATTTTGCTCAATTAGCCAAAGATAATTCAAC
TGATGAAAAACAAAAGAAAATGGTGGAGAAATTACCTTTGATTCTGCTTCAACAGAAGTACCTGGAGC
AAGTCCAAAAAAGCCGCTTTTCGCTTTTAGATGTGGGATGGTGTTTCTGGATGTGGATTACAGCAACTG
GGGCACACCAAGCCTACAG SP021 amino acid (SEQ ID NO:34)
SKGSEGADLISMKGDVITEHQFYEQVKSNPSAQQVLLNMTIQKVFEKQYGSELDDKEVDDTIAEEKKQY
GENYQRVLSQAGMTLETRKAQIRTSKLVELAVKKVAEAELTDEAYKKAFDEYTPDVTAQIIRLNNEDKA
KEVLEKAKAEGADFAQLAKDNSTDEKTKEGGGEITFDSASTEVPGASPKKPLFAFRCGMVFLDVDYSNW
GTPSLQ SP022 nucleotide (SEQ ID NO:35)
GGGGATGGCAGCTTTTAAAAATCCTAACAATCAATACAAAGCTATTACAATTGCTCAAACTCTAGGTGA
TGATGCTTCTTCAGAGGAATTGGCTGGTAGATATGGTTCTGCTGTTCAGTGTACAGAAGTGACTGCCTC
AAACCTTTCAACAGTTAAAACTAAAGCTACGGTTGTAGAAAAACCACTGAAAGATTTTAGAGCGTCTAC
GTCTGATCAGTGTGGTTGGGTGGAATCTAATGGTAAATGGTATTTCTATGAGTCTGGTGATGTGAAGAC
AGGTTGGGTGAAAACAGATGGTAAATGGTACTATTTGAATGACTTAGGTGTCATGCAGACTGGATTTGT
AAAATTTTCTGGTAGCTGGTATTACTTGAGCAATTCAGGTGCTATGTTTACAGGCTGGGGAACAGATGG
TAGCAGATGGTTCTACTTTGACGGCTCAGGAGCTATGAAGACAGGCTGGTACAAGCAAATGGCACTTG
GTATTACCTTGACGAAGCAGGTATCATGAAGACAGGTTGGTTTAAAGTCGGACCACACTGGTACTATGC
CTACGGTTCAGGAGCTTTGGCTGTGAGCACAACAACACCAGATGGTTACCGTGTAAATGGTAATGGTGA
ATGGGTAAAC SP022 amino acid (SEQ ID NO:36)
GMAAFKNPNNQYKAITIAQTLGDDASSEELAGRYGSAVQCTEVTASNLSTVKTKATVVEKPLKDFRAST
SDQSGWVESNGKWYFYESGDVKTGWVKTDGKWYYLNDLGVMQTGFVKFSGSWYYLSNSGAMFTGWGTDG
SRWFYFDGSGAMKTGWYKENGTWYYLDEAGIMKTGWFKVGPHWYYAYGSGALAVSTTTPDGYRVNGNGE
WVN SP023 nucleotide (SEQ ID NO:37)
AGACGAGCAAAAAATTAAGCAAGCAGAAGCGGAAGTTGAGAGTAAACAAGCTGAGGCTACAAGGTTAAA
AAAAATCAAGACAGATCGTGAAGAAGCAGAAGAAGAAGCTAAACGAAGAGCAGATGCTAAAGAGCAAGG
TAAACCAAAGGGGCGGGCAAAACGAGGAGTTCCTGGAGAGCTAGCAACACCTGATAAAAAAGAAAATGA
TGCCAAGTCTTCAGATTCTAGCGTAGGTGAAGAAACTCTTCCAAGCCCATCCCTGAAACCAGAAAAAAA
GGTAGCAGAAGCTGAGAAGAAGGTTGAAGAAGCTAAGAAAAAGCCGAGGATCAAAAGAAGAAGATCG
CCGTAACTACCCAACCAATACTTACAAAACGCTTGAACTTGAAATTGCTGAGTCCGATGTGGAAGTTAA
AAAAGCGGAGCTTGAACTAGTAAAAGAGGAAGCTAAGGAACCTCGAAACGAGGAAAAAGTTAAGCAAGC
AAAAGCGGAAGTTGAGAGTAAAAAAGCTGAGGCTACAAGGTTAGAAAAAATCAAGACAGATCGTAAAA
AGCAGAAGAAGAAGCTAAACGAAAAGCAGCAGAAGAAGATAAAGTTAAAGAAAAACCAGCTGAACAACC
ACAACCAGCGCCGGCTCCAAAAGCAGAAAAACCAGCTCCAGCTCCAAAACCAGAGAATCCAGCTGAACA
ACCAAAAGCAGAAAAACCAGCTGATCAACAAGCTGAAGAAGACTATGCTCGTAGATCAGAAGAAGAATA
TAATCGCTTGACTCAACAGCAACCGCCAAAAACTGAAAAACCAGCACAACCATCTACTCCAAAAACAGG
CTGGAAACAAGAAAACGGTATGTGGTACTTCTACAATACTGATGGTTCAATGGCGACAGGATGGCTCCA
AAACAATGGCTCATGGTACTACCTCAACAGCAATGGCGCTATGGCGACAGGATGGCTCCAAAACAATGG
TTCATGGTACTATCTAAACGCTAATGGTTCAATGGCAACAGGATGGCTCCAAAACAATGGTTCATGGTA
CTACCTAAACGCTAATGGTTCAATGGCGACAGGATGGCTCCAATACAATGGCTCATGGTACTACCTAAA
CGCTAATGGTTCAATGGCGACAGGATGGCTCCAATACAATGGCTCATGGTACTACCTAAACGCTAATGG
TGATATGGCGACAGGTTGGGTGAAAGATGGAGATACCTGGTACTATCTTGAAGCATCAGGTGCTATGAA
AGCAAGCCAATGGTTCAAAGTATCAGATAAATGGTACTATGTCAATGGCTCAGGTGCCCTTGCAGTCAA
CACAACTGTAGATGGCTATGGAGTCAATGCCAATGGTGAATGGGTAAAC SP023 amino acid (SEQ ID NO:38)
DEQKIKQAEAEVESKQAEATRLKKIKTDREEAEEEAKRRADAKEQGKPKGRAKRGVPGELATPDKKEND
AKSSDSSVGEETLPSPSLKPEKKVAEAEKKVEEAKKKAEDQKEEDRRNYPTNTYKTLELEIAESDVEVK
KAELELVKEEAKEPRNEEKVKQAKAEVESKKAEATRLEKIKTDRKKAEEEAKRKAAEEDKVKEKPAEQP
QPAPAPKAEKPAPAPKPENPAEQPKAEKPADCQAEEDYARRSEEEYNRLTQQQPPKTEKPAQPSTPKTG
WKQENGMWYFYNTDGSMATGWLQNNGSWYYLNSNGAMATGWLQNNGSWYYLNANGSMATGWLQNNGSWY
YLNANGSMATGWLQYNGSWYYLNANGSMATGWLQNNGSWYYLNANGSWYLQYNGSWYYLNANGDMATGWVKDGDTWYYLEASGAMK
ASQWFKVSDKWYYVNGSGALAVNTTVDGYGVNANGEWVN SP025 nucleotide (SEQ ID NO:39)
CTGTGGTGAGGAAGAAACTAAAAAGACTCAAGCAGCACAACAGCCAAAACAACAAACGACTGTACAACA
AATTGCTGTTGGAAAAGATGCTCCAGACTTCACATTGCAATCCATGGATGGCAAAGAAGTTAAGTTATC
TGATTTTAAGGGTAAAAGGTTTACTTGAAGTTTTGGGCTTCATGGTGTGGTCCATGCAAGAAAGTAT
GCCAGAGTTGATGGAACTAGCGGCGAAACCAGATCGTGATTTCGAAATTCTTACTGTCATTGCACGAGG
AATTCAAGGTGAAAAAACTGTTGAGCAATTCCCACAATGGTTCCAGGAACAAGGATATAAGGATATCCC
AGTTCTTTATGATACCAAAGCAACCACTTCCAAGCTTATCAAATTCGAAGCATTCCTACAGAATATT TABLE 1-continued SP025 amino acid (SEQ ID NO:40)
CGEEETKKTQAAQQPKQQTTVQQIAVGKDAPDFTLQSMDGKEVKLSDFKGKKVYLKFWASWCGPCKKSM
PELMELAAKPDRDFEILTVIAPGIQGEKTVEQFPQWFQEQGYKDIPVLYDTKATTSKLIKFEAFLQNI SP029 nucleotide (SEQ ID NO:41)
GACTTTTAACAATAAAACTATTGAAGAGTTGCACAATCTCCTTGTCTCTAAGGAAATTTCTGCAACAGA
ATTGACCCAAGCAACACTTGAAAATATCAAGTCTCGTGAGGAAGCCCTCAATTCATTTGTCACCATCGC
TGAGGAGCAAGCTCTTGTTCAAGCTAAAGCCATTGATGAAGCtGGAATTGATGCTGACAATGTCCTTTC
AGGAATTCCACTGGCTGTTAAGGATAACATCTCTACAGACGGTATTCTCACAACTGCTGCCTCAAAAAT
GCTCTACAACTATGAGCCAATCTTTGATGCGACAgCTgTTGCCAATGCAAAAACCAAGGGCATGATTGT
CGTTGGAAAGACCAACATGGACGAATTTGCTATGGGTGGTTCAGGtGAAACTTCACACTACGGAGCAAC
TAAAAACGCTTGGAACCACAGCAAGGTTCCTGGTGGGTCATCAAGTGGTTCTGCCGCAGCTGTAGCCTC
AGGACAAGTTCGCTTGTCACTTGGTTCTGATACTGGTGGTTCCATCCGCCAACCTGCTGCCTTCAACGG
AATCGTGGGTCTCAAACCAACCTACGGAACACTTTCACGTTTCGGTCTCATTGCCTTTGGTAGCTCATT
AGACCAGATTGGACCTTTTGCTCCTACTGTTAAGGAAAATGCCCTCTTGCTCAACGCTATTGCCAGCGA
AGATGCTAAAGACTCTACTTCTGCTCCTGTCCGCATCGCCGACTTTACTTCAAAAATCGGCCAAGACAT
CAAGGGTATGAAAATCGCTTTGCCTAAGGAATACCTAGGCGAAGGAATTGATCCAGAGGTTAAGGAAAC
AATCTTAAACGCGGCCAAACACTTTGAAAAATTGGGTGCTATCGTCGAAGAAGTCAGCCTTCCTCACTC
TAAATACGGTGTTGCCGTTTATTACATCATCGCTTCATCAGAAGCTTCATCAAACTTGCAACGCTTCGA
CGGTATCCGTTACGGCTATCGCGCAGAAGATGCAACCAACCTTGATGAAATCTATGTAAACAGCCGAAG
CCAAGGTTTTGGTGAAGAGGTAAAACGTCGTATCATGCTGGGTACTTTCAGTCTTTCATCAGGTTACTA
TGATGCCTACTACAAAAAGGCTGGTCAAGTCCGTACCCTCATCATTCAAGATTTCGAAAAAGTCTTCGC
GGATTACGATTTGATTTTGGGTCCAACTGCTCCAAGTGTTGCCTATGACTTGTCTCTCAACCATGA
CCCAGTTGCCATGTACTTAGCCGACCTATTGACCATACCTGTAAACTTGGCAGGACTGCCTGGAATTTC
GATTCCTGCTGATTCTCTCAAGGTCTACCTGTCGGACTCCAATTGATTGGTCCCAAGTACTCTGAGGA
AACCATTTACCAAGCTGCTGCTGCTTTTGAAGCAACAACAGATACCACAAACAACAACCCGTGATTTT
TGGAGGTGACAAC SP028 amino acid (SEQ ID NO:42)
TFNNKTIEELHNLLVSKEISATELTQATLENIKSREEALNSFVTIAEEQALVQAKAIDEAGIDADNVLS
GIPLAVKDNISTDGILTTAASKMLYNYEPIFDATAVANAKTKGMIVVGKTNMDEFAMGGSGETSHYGAT
KNAWNHSKVPGGSSSGSAAAVASGQVRLSLGSDTGGSIRQPAAFNGIVGLKPTYGTVSRFGLIAFGSSL
DQIGPFAPTVKENALLLNAIASEDAKDSTSAPVRIADFTSKIGQDIKGMKIALPKEYLGEGIDPEVKET
ILNAAKHFEKLGAIVEEVSLPHSKYGVAVYYIIASSEASSNLQRFDGIRYGYRAEDATNLDEIYVNSRS
QGFGEEVKRRIMLGTFSLSSGYYDAYYKKAGQVRTLIIQDFEKVFADYDLILGPTAPSVAYDLDSLNHD
PVAMYLADLLTIPVNLAGLPGISIPAGFSQGLFVGLQLIGPKYSEETIYQAAAAFEATTDYHKQQPVIF
GGDN SP030 nucleotide (SEQ ID NO:43)
CTTTACAGGTAAACAACTACAAGTCGGCGACAAGGCGCTTGATTTTTCTCTTACTACAACAGATCTTTC
TAAAAAATCTCTGGCTGATTTTGATGGCAAGAAAAAAGTCTTGAGTGTCGTTCCTTCTATCGATACAGG
CATCTGCTCAACTCAAACACGTCGTTTTAATGAAGAATTGGCTGGACTGGACAACACGGTCGTATTGAC
TGTTTCAATGGACCTACCTTTTGCTCAAAAACGTTGGTGCGGTGCTGAAGGCCTTGACAATGCCATTAT
GCTTTCAGACTACTTTGACCATTCTTTCGGGCGCGATTATGCCCTCTTGATCAACGAATGGCACCTATT
AGCACGCGCAGTCTTTGTCCTCGATACTGACAATACGATTCGCTACGTTGAATACGTGGATAATATCAA
TTCTGAGCCAAACTTCGAA SP030 amino acid (SEQ ID NO:44)
FTGKQLQVGDKALDFSLTTTDLSKKSLADFDGKKKVLSVVPSIDTGICSTQTRRFNEELAGLDNTVVLT
VSMDLPFAQKRWCGAEGLDNAIMLSDYFDHSFGRDYALLINEWHLLARAVFVLDTDNTIRYVEYVDNIN
SEPNPE SP031 nucleotide (SEQ ID NO:45)
CCAGGCTGATACAAGTATCGCAGACATTCAAAAAAGAGGCGAACTGGTTGTCGGTGTCAAACAAGACGT
TCCCAATTTTGGTTACAAnGATCCCAAGACCGGTACTTATTCTGGTATCGAAaCCGACTTGGCCAAGAT
GGTAGCTGATGAACTCAAGGTCAAGATTCGCTATGTGCCGGTTACAGCACAAACCCGCGGCCCCCTTCT
AGACAATGAACAGGTCGATATGGATATCGCGACCTTTACCATCACGGACGAACGCAAAAAACTCTACAA
CTTTACCAGTCCCTACTACACAGACGCTTCTGGATTTTTGGTCAATAAATCTGCCAAAATCAAAAAGAT
TGAGGACCTAAACGGCAAAACCATCGGAGTCGCCCAAGGTTCTATCACCCAACGCCTGATTACTGAACT
GGGTAAAAAGAAAGGTCTGAAGTTTAAATTCGTCGAACTTGGTTCCTACCCAGAATTGATTACTTCCCT
GCACGCTCATCGTATCGATACCTTTTCCGTTGACCGCTCTATTCTATCTGGCTACACTAGTAAACGGAC
AGCACTACTAGATGATAGTTTCAAGCCATCTGACTACGGTATTGTTACCAAGAAATCAAATACAGAGCT
CAACGACTATCTTGATAACTTGGTTACTAAATGGAGCAAGGATGGTAGTTTGCAGAAACTTTATGACCG
TTACAAGCTCAAACCATCTAGCCATACTGCAGAT SP031 amino acid (SEQ ID NO:46)
QADTSIADIQKRGELVVGVKQDVPNFGYXSDPKTGTYSGIETDLAKMVADELKVKIRYVPVTAQTRGPLL
DNEQVDMDIATFTITDERKKLYNFTSPYYTDASGFLVNKSAKIKKIEDLNGKTIGVAQGSITQRLITEL
GKKKGLKFKFVELGSYPELITSLHAHRIDTFSVDRSILSGYTSKRTALLDDSFKPSDYGIVTKKSNTEL
NDYLDNLVTKWSKDGSLQKLYDRYKLKPSSHTAD SP032 nucleotide (SEQ ID NO:47)
GTCTGTATCATTTGAAAACAAAGAAACAAACCGTGGTGTCTTgACTTTCACTATCTCTCAAGACCAAAT
CAAACCAGAATTGGACCGTGTCTTCAAGtCAGTGAAGAAATCTCTTAATGTTCCAGGTTTCCGTAAAGG
TCACCTTCCACGCCCTATCTTCGACCAAAAATTTGGTGAAGAAGCTCTTTATCAAGATGCAATGAACGC
ACTTTTTGCCAAACGCTTATGAAGCAGCTGTAAAAGAAGCTGGTCTTGAAGTGGTTGCCCAACCAAAAAT
TGACGTAACTTCAATGGAAAAAGGTCAAGACTGGGTTATCACTGCTGAAGTCGTTACAAAACCTGAAGT
AAAATTGGGTGACTACAAAAACCTTGAAGTATCAGTTGATGTAGAAAAGAAGTAACTGACGCTGATGT TABLE 1-continued

```
CGAAGAGCGTATCGAACGCGAACGCAACAACCTGGCTGAATTGGTTATCAAGGAAGCTGCTGCTGAAAA
CGGCGACACTGTTGTGATCGACTTCGTTGGTTCTATCGACGGTGTTGAATTTGACGGTGGAAAAGGTGA
AAACTTCTCACTTGGACTTGGTTCAGGTCAATTCATCCCTGGTTTCGAAGACCAATTGGTAGGTCACTC
AGCTGGCGAAACCGTTGATGTTATCGTAACATTCCCAGAAGACTACCAAGCAGAAGACCTTGCAGGTAA
AGAAGCTAAATTCGTGACAACTATCCACGAAGTAAAAGCTAAAGAAGTTCCGGCTCTTGACGATGAACT
TGCAAAAGACATTGATGAAGAGTTGAAACACTTGCTGACTTGAAAGAAAAATACAGCAAAGAATTGGC
TGCTGCTAAAGAAGAAGCTTACAAAGATGCAGTTGAAGGTGCAGCAATGGATACAGCTGTAGAAAATGC
TGAAATCGTAGAACTTCCAGAAGAAATGATGCATGAAGAAGTTCACCGTTCAGTAAATGAATTCCTTGG
GAATTTGCAACGTCAAGGGATCAACCCTGACATGTACTTCCAAATCACTGGAACTACTCAAGAAGACCT
TCACAACCAATACCAAGCAGAAGCTGAGTCACGTACTAAGACTAACCTTGTTATCGAAGCAGTTGCCAA
AGCTGAAGGATTTGATGCTTCAGAAGAAGAAATCCAAAAAGAAGTTGAGCAATTGGCAGCAGACTACAA
CATGGAAGTTGCACAAGTTCAAAACTTGCTTTCAGCTGACATGTTGAAACATGATATCACTATCAAAAA
AGCTGTTGAATTGATCACAAGCACAGCAACAGTAAAA

SP032 amino acid (SEQ ID NO:48)
SVSFENKETNRGVLTFTISQDQIKPELDRVFKSVKKSLNVPGFRKGHLPRPIFDQKFGEEALYQDAMNA
LLPNAYEAAVKEAGLEVVAQPKIDVTSMEKGQDWVITAEVVTKPEVKLGDYKNLEVSVDVEKEVTDADV
EERIERERNNLAELVIKEAAAENGDTVVIDFVGSIDGVEFDGGKGENFSLGLGSGQFIPGFEDQLVGHS
AGETVDVIVTFPEDYQAEDLAGKEAKFVTTIHEVKAKEVPALDDELAKDIDEEVETLADLKEKYSKELA
AAKEEAYKDAVEGAAIDTAVENAEIVELPEEMIHEEVHRSVNEFLGNLQRQGINPDMYFQITGTTQEDL
HNQYQAEAESRTKTNLVIEAVAKAEGFDASEEEIQKEVEQLAADYMMEVAQVQNLLSADMLKHDITIKK
AVELITSTATVK SP033 nucleotide (SEQ ID NO:49)
TGGTCAAAAGGAAAGTCAGACAGGAAAGGGGATGAAAATTGTGACCAGTTTTTATCCTATCTACGCTAT
GGTTAAGGAAGTATCTGGTGACTTGAATGATGTTCGGATGATTCAGTCAAGTAGTGGTATTCACTCCTT
TGAACCTTCGGCAAATGATATCGCAGCCATCTATGATGCAGATGTCTTTGTTTACCATTCTCATACACT
CGAATCTTGGGCAGGAAGTCTGGATCCAAATCTAAAAAAATCCAAAGTGAAGGTCTTAGAGGCTTCTGA
GGGAATGACCTTGGAACGTGTCCCTGGACTAGAGGATGTGGAAGCAGGGGATGGAGTTGATGAAAAAC
GCTCTATGACCCTCACACATGGCTAGATCCTGAAAAAGCTGGAGAAGAAGCCCAAATTATCGCTGATAA
ACTTTCAGAGGTGGATAGTGAGCATAAAGAGACTTATCAAAAAAATGCGCAACCTTTATCAAAAAAGCT
CAGGAAT SP033 amino acid (SEQ ID NO:50)
GQKESQTGKGMKIVTSFYPIYAMVKEVSGDLNDVRMIQSSSGIHSFEPSANDIAAIYDADVFVYHSHTL
ESWAGSLDPNLKKSKVKVLEASEGMTLERVPGLEDVEAGDGVDEKTLYDPHTWLDPEKAGEEAQIIADK
LSEVDSEHKETYQKNAQPLSKKLRN SP034 nucleotide (SEQ ID NO:51)
GAAGGATAGATATATTTTAGCATTTGAGACATCCTGTGATGAGACCAGTGTCGCCGTCTTGAAAAACGA
CGATGAGCTCTGTCCAATGTCATTGCTAGTCAAATTGGAGAGTCACAAACGTTTTGGTGGCGTAGTGCC
CGAAGTAGCCAGTCGTCACCATGTCGAGGTCATTACAGCCTGTATCGAGGAGGCATTGGCAGAAGCAGG
GATTACCGAAGAGGACGTGACAGCTGTTGCGGTTACCTACGGACCAGGCTTGGTCGGAGCCTTGCTAGT
TGGTTTGTCAGCTGCCAAGGCCTTTGCTTGGGCTCACGGACTTCCACTGATTCCTGTTAATCACATGGC
TGGGCACCTCATGGCAGCTCAGAGTGTGGAGCCTTTGGAGTTTCCACTTGCTAGCCCTCTTGGTCAGCG
CGGACACACAGAGTTGGTTTATGTTTCGGAGGCAGGAGATTATAAGATTGTTGGGGAAACCCGTGATGA
TGCGGTTGGTGAGGCTTATGATAAGGTCGGGCGTGTCATGGGCTTGACCTATCCTGCAGGTCGTGAGAT
TGACGAGCTGGCTCATCAGGGGCAGGATATTTATGATTTCCCCCGTGCCATGATTAAGGAAGATAATCT
GGAGTTCTCCTTCTCAGGTTTGAAATCTGCCTTTATCAATCTTCATCACAATGCCGAGCAAAAGGGAGA
AAGCCTGTCTACAGAAGATTTGTGTGCTTCCTTCCAAGCAGCAGTTATGGACATTCTCATGGCAAAAAC
CAAGAAGGCTTTGGAGAAATATCCTGTTAAAATCCTAGTTGTGGCAGGTGGTGTGGCAGCCAATAAAGG
TCTCAGAGAACGCCTAGCAGCCGAAATCACAGATGTCAAGGTTATCATCCCCCCTCTGCGACTCTGCGG
AGACAATGCAGGTATGATTGCCTATGCCAGCGTCAGCNAGTGGAACAAAGAAAACTTCGCAGGCTGGGA
CCTCAATGGCAAACCAAGTCTTGCCTTTGATACCATGGAA SP034 amino acid (SEQ ID NO:52)
KDRYILAFETSCDETSVAVLKNDDELLSNVIASQIESHKRFGGVVPEVASRHHVEVITACIEEALAEAG
ITEEDVTAVAVTYGPGLVGALLVGLSAAKAFAWAHGLPLIPVNHMAGHLMAAQSVEPLEFPLLALLVSG
GHTELVYVSEAGDYKIVGETRDDAVGEAYDKVGRVMGLTYPAGREIDELAHQGQDIYDFPRAMIKEDNL
EFSFSGLKSAFINLHHNAEQKGESLSTEDLCASFQAAVMDILMAKTKKALEKYPVKILVVAGGVAANKG
LRERLAAEITDVKVIIPPLRLCGDNAGMIAYASVSXWNKENFAGWDLNAKPSLAFDTME SP035 nucleotide (SEQ ID NO:53)
GGTAGTTAAAGTTGGTATTAACGGTTTCGGACGTATCGGTCGTCTTGCTTTCCGTCGTATCCAAAACGT
AGAAGGTGTTGAAGTTACACGCATCAACGACCTTACAGATCCAGTTATGCTTGCACACTTGTTGAAATA
CGACACAACTCAAGGTCGTTTCGACGGTACTGTTGAAGTTAAAGAAGGTGGATTTGAAGTTAACGGTAA
ATTCATCAAAGTTTCTGCTGAACGTGATCCACAACAAATCGACTGGGCTACTGACGGTGTAGAAATCGT
TCTTGAAGCTACTGGTTTCTTTGCTAAGAAAGAAGCAGCTGAAAAACACCTTAAAGGTGGAGCTAAAAA
AGTTGTTATCACTGCTCCTGGTGGAAACGACGTTAAAACAGTTGTATTCAACACTAACCACGACGTTCT
TGACGGTACTGAAACAGTTATCTCAGGTGCTTCATGTACTACAAACTGCTTGGCTCCAATGGCTAAAGC
TCTTCAAGACAACTTTGGTGTTGTTGAAGGATTGATGACTACTATCCACGCTTACACTGGTGACCAAAT
GATCCTTGACGGACCACACCGTGGTGGTGACCTTCGCCGTGCTCGCGCTGGTGCTGCAAACATCGTTCC
TAACTCAACTGGTGCTGCAAAAGCTATCGGTCTTGTAATCCCAGAATTGAATGCTAAACTTGACGGATC
TGCACAACGCGTTCCAACTCCAACTGGATCAGTTACTGAATTGGTAGCAGTTCTTGAAAAGAACGTTAC
TGTTGATGAAGTGAACGCAGCTATGAAAGCAGCTTCAAACGAATCATACGGTTACACAGAAGATCCAAT
CGTATCTTCAGATATCGTAGGTATGTCTTACGGTTCATTGTTTGACGCAACTCAAACTAAAGTTCTTGA
CGTTGACGGTAAACAATTGGTTAAAGTTGTATCATGGTACGACAACGAAATGTCATACACTGCACAACT
TGTTCGTACTCTTGGAATACTTCGCAAAAATTGC
```

TABLE 1-continued

SP035 amino acid (SEQ ID NO:54)
VVKVGINGFGRIGRLAFRRIQNVEGVEVTRINDLTDPVMLAHLLKYDTTQGRFDGTVEVKEGGFEVNGK
FIKVSAERDPEQIDWATDGVEIVLEATGFFAKKEAAEKHLKGGAKKVVITAPGGNDVKTVFFNTNHDVL
DGTETVISGASCTTNCLAPMAKALQDNFGVVEGLMTTIHAYTGDQMILDGPHRGGDLRRARAGAANIVP
NSTGAAKAIGLVIPELNGKLDGSAQRVPTPTGSVTELVAVLEKNVTVDEVNAAMKAASNESYGYTEDPI
VSSDIVGMSYGSLFDATQTKVLDVDGKQLVKVVSWYDNEMSYTAQLVRTLGILRKNC SP036 nucleotide (SEQ ID NO:55)
TTCTTACGAGTTGGGACTGTATCAAGCTAGAACGGTTAAGGAAAATAATCGTGTTTCCTATATAGATGG
AAAACAAGCGACGCAAAAAACGGAGAATTTGACTCCTGATGAGGTTAGCAAGCGTGAAGGAATCAATGC
TGAGCAAATCGTCATCAAGATAACAGACCAAGGCTATGTCACTTCACATGGCGACCACTATCATTATTA
CAATGGTAAGGTTCCTTATGACGCTATCATCAGTGAAGAATTACTCATGAAAGATCCAAACTATAAGCT
AAAAGATGAGGATATTGTTAATGAGGTCAAGGGTGGATATGTTATCAAGGTAGATGGAAAATACTATGT
TTACCTTAAGGATGCTGCCCACGCGGATAACGTCCGTACAAAAGAGGAAATCAATCGACAAAACAAGA
GCATAGTCAACATCGTGAAGGTGGAACTCCAAGAAACGATGGTGCTGTTGCCTTGGCACGTTCGCAAGG
ACGCTATACTACAGATGATGGTTATATCTTTAATGCTTCTGATATCATAGAGGATACTGGTGATGCTTA
TATCGTTCCTCATGGAGATCATTACCATTACATTCCTAAGAATGAGTTATCAGCTAGCGAGTTGGCTGC
TGCAGAAGCCTTCCTATCTGGTCGAGGAAATCTGTCAAATTCAAGAACCTATCGCCGACAAAATAGCGA
TAACACTCCAAGAACAAACTGGGTACCTTCTGTAAGCAATCCAGGAACTACAAATACTAACACAAGCAA
CAACAGCAACACTAACAGTCAAGCAAGTCAAAGTAATGACATTGATAGTCTCTTGAAACAGCTCTACAA
ACTGCCTTTGAGTCAACGACATGTAGAATCTGATGGCCTTCTCTTTGATCCAGCACAAATCACAAGTCG
AACAGCTAGAGGTGTTGCAGTGCCACACGGAGATCATTACCACTTCATCCCTTACTCTCAAATGTCTGA
ATTGGAAGAACGAATGGCTCGTATTATTCCCCTTCGTTATCGTTCAAACCATTGGGTACCAGATTCAAG
GCCAGAACAACCAAGTCCACAACCGACTCCGGAACCTAGTCCAGGCCCGCAACCTGCACCAAATCTTAA
AATAGACTCAAATTCTTCTTTGGTTAGTCAGCTGGTACGAAAAGTTGGGGAAGGATATGTATTCGAAGA
AAAGGGCATCTCTCGTTATGTCTTTGCGAAAGATTTACCATCTGAAACTGTTAAAAATCTTGAAAGCAA
GTTATCAAAACAAGAGAGTGTTTCACACACTTTAACTGCTAAAAAAGAAAATGTTGCTCCTCGTGACCA
AGAATTTTATGATAAAGCATATAATCTGTTAACTGAGGCTCATAAAGCCTTGTTTTGNAAATAAGGGTCG
TAATTCTGATTTCCAAGCCTTAGACAAATTATTAGAACGCTTGAATGATGAATCGACTAATAAAGAAAA
ATTGGTAGATGATTTATTGGCATTCCTAGCACCAATTACCCATCCAGAGCGACTTGGCAAACCAAATTC
TCAAATTGAGTATACTGAAGACGAAGTTCGTATTGCTCAATTAGCTGATAAGTATACAACGTCAGATGG
TTACATTTTTGATGAACATGATATAATCAGTGATGAAGGAGATGCATATGTAACGCCTCATATGGGCCA
TAGTCACTGGATTGGAAAAGATAGCCTTTCTGATAAGGAAAAAGTTGCAGCTCAAGCCTATACTAAAGA
AAAAGGTATCCTACCTCCATCTCCAGACGCAGATGTTAAAGCAAATCCAACTGGAGATAGTCAGCAGC
TATTTACAATCGTGTGAAAGGGGAAAAACGAATTCCACTCGTTCGACTTCCATATATGGTTGAGCATAC
AGTTGAGGTTAAAAACGGTAATTTGATTATTCCTCATAAGGATCATTACCATAATATTAAATTTGCTTG
GTTTGATGATCACACATACAAAGCTCCAAATGGCTATACCTTGGAAGATTTGTTTGCGACGATTAAGTA
CTACGTAGAACACCCTGACGAACGTCCACATTCTAATGATGGATGGGGCAATGCCAGTGAGCATGTGTT
AGGCAAGAAAGACCACAGTGAAGATCCAAATAAGAACTTCAAAGCGGATGAAGAGCCAGTAGAGGAAAC
ACCTGCTGAGCCAGAAGTCCCTCAAGTAGAGACTGAAAAAGTAGAAGCCCAACTCAAAGAAGCAGAAGT
TTTGCTTGCGAAAGTAACGGATTCTAGTCTGAAAGCCAATGCAACAGAAACTCTAGCTGGTTTACGAAA
TAATTTGACTCTTCAAATTATGGATAACAATAGTATCATGGCAGAAGCAGAAAAATTACTTGCGTTGTT
AAAAGGAAGTAATCCTTCATCTGTAAGTAAGGAAAAAATAAAC SP036 amino acid (SEQ ID NO:56)
SYELGLYQARTVKENNRVSYIDGKQATQKTENLTPDEVSKREGINAEQIVIKITDQGYVTSHGDHYHYY
NGKVPYDAIISEELLMKDPNYKLKDEDIVNEVKGGYVIKVDGKYYVYLKDAAHADNVRTKEEINRQKQE
HSQHREGGTPRNDGAVALARSQGRYTTDDGYIFNASDIIEDTGDAYIVPHGDHYHYIPKNELSASELAA
AEAFLSGRGNLSNSRTYRRQNSDNTSRTNWVPSVSNPGTTNTNSNNSNTNSQASQSNDIDSLLKQLYK
LPLSQRHVESDGLVFDPAQITSRTARGVAVPHGDHYHFIPYSQMSELEERIARIIPLRYRSNHWVPDSR
PEQPSPQPTPEPSPGPQPAPNLKIDSNSSLVSQLVRKVGEGYVFEEKGISRYVFAKDLPSETVKNLESK
LSKQESVSHTLTAKKENVAPRDQEFYDKAYNLLTEAHKALFXNKGRNSDFQALDKLLERLNDESTNKEK
LVDDLLAFLAPITHPERLGKPNSQIEYTEDEVRIAQLADKYTTSDGYIFDEHDIISDEGDAYVTPHMGH
SHWIGKDSLSDKEKVAAQAYTKEKGILPPSPDADVKANPTGDSAAAIYNRVKGEKRIPLVRLPYMVEHT
VEVKNGNLIIPHKDHYHNIKFAWFDDHTYKAPNGYTLEDLFATIKYYVEHPDERPHSNDGWGNASEHVL
GKKDHSEDPNKNFKADEEPVEETPAEPEVPQVETEKVEAQLKEAEVLLAKVTDSSLKANATETLAGLRN
NLTLQIMDNNSIMAEAEKLLALLKGSNPSSVSKEKIN SP038 nucleotide (SEQ ID NO:57)
TACTGAGATGCATCATAATCTAGGAGCTGAAAAGCGTTCAGCAGTGGCTACTACTATCGATAGTTTTAA
GGAGCGAAGTCAAAAAGTCAGAGCACTATCTGATCCAAATGTGCGTTTTGTTCCCTTCTTTGGCTCTAG
TGAATGGCTTCGTTTTGACGGTGCTCATTCTGCGGTATTAGCTGAGAAATACAATCGTTCCTACCGTCC
TTATCTTTTAGGACAGGGGGGAGCTGCATCGCTTAACCAATATTTTGGAATGCAACAGATGTTACCACA
GCTGGAGAATAAACAAGTTGTGTATGTTATCTCACCTCAGTGGTTCAGTAAAAATGGCTATGATCCAGC
AGCCTTCCAGCAGTATTTTAATGGAGACCAGTTGACTAGTTTTCTGAAACATCAATCTGGGGATCAGGC
TAGTCAATATGCAGCGACTCGCTTACTGCAACAGTTCCCAAACGTAGCTATGAAGGACCTGGTTCAGAA
GTTGGCAAGTAAAGAAGAATTGTCGACAGCAGACAATGAAATGATTGAATTATTGGCTCGTTTTAATGA
ACGCCAAGCTTCCTTTTTTGGTCAGTTTTCGGTTAGAGGCTATGTTAACTACGATAAGCATGTAGCTAA
GTATTTAAAAATCTTGCCAGACACAGTTTTCTTATCAGGCAATAGAAGATGTTGTCAAAGCAGATGCTGA
AAAAAATACTTCCAATAATGAGATGGGAATGGAAAATTATTTCTATAATGAGCAGATCAAGAAGGATTT
GAAGAAATTAAAGGATTCTCAGAAAAGCTTTACCTATCTCAAGTCGCCAGAGTATAATGNNTTGCAGTT
GGTTTTAACACAGTTTTCTAAATCTAAGGTAAACCCGATTTTTATCATTCCACCTGTTAATAAAAAATG
GATGNACTATGCTGGTCTACGAGAGGATATGTACCAACAAACGGTGCAGAAGATTCGCTACCAGTTAGA
AAGTGAAGGTTTTACCAATATAGCAGATTTTTCTAAGGACGGCGGGAGCCTTTCTTTATGAAGGACAC
CATTCACCTTGGTTGGTTGGGTTGGTTGGCTTTTGACAAGGCAGTTGATCCTTTCCTATCGCAATCCCAC
ACCAGCTCCGACTTACCATCTGAATGAGCGCTTTTTCAGCAAAGATTGGGCGACTTATGATGGAGATGT
CAAAGAA SP038 amino acid (SEQ ID NO:58)

TABLE 1-continued

TEMHHNLGAEKRSAVATTIDSFKERSQKVRALSDPNVRFVPFFGSSEWLRFDGAHSAVLAEKYNRSYRP
YLLGQGGAASLNQYFGMQQMLPQLENKQVVYVXSPQWFSKYGYDPAAFQQYFNGDQLTSFLKHQSGDQA
SQYAATRLLQQFPNVAMKDLVQKLASKEELSTADNEMIELLARFNERQASFFGQFSVRGYVNYDKHVAK
YLKILPDQFSYQAIEDVVKADAEKNTSNNEMGMENYFYNEQIKKDLKKLKDSQKSFTYLKSPEYNXLQL
VLTQFSKSKVNPIFIIPPVNKKWMXYAGLREDMYQQTVQKIRYQLESQGFTNIADFSKDGGEPFFMKDT
IHLGWLGWLAFDKAVDPFLSNPTPAPTYHLNERFFSKDWATYDGDVKE

SP039 nucleotide (SEQ ID NO:59)
GGTTTTGAGAAAGTATTTGCAGGGGGCCCTGATTGAGTCGATTGAGCAAGTGGAAAATGACCGTATTGT
GGAAATTACAGTTTCCAATAAAAACGAGATTGGAGACCATATCCAGGCTACCTTGATTATCGAAATTAT
GGGGAAACACAGTAATATTCTACTGGTCGATAAAAGCAGTCATAAAATCCTCGAAGTTATCAAACACGT
CGGCTTTTCACAAAATAGCTACCGCACCTTACTTCCAGGATCGACCTATATCGCTCCGCCAAGTACAAA
ATCTCTCAATCCTTTTACTATCAAGGATGAAAAGCTCTTTGAAATCCTGCAAACCCAAGAACTAACAGC
AAAAAAATCTTCAAAGCCTCTTTCAAGGTCTGGGACGGGATACGGCAAATGAATTGGAAAGGATACTGGT
TAGTGAAAAACTTTCCGCTTTCCGAAATTTTTTCAATCAAGAAACCAAGCCATGCTTGACTGAGACTTC
CTTCAGTCCAGTTCCTTTTGCAAATCAGGTGGGAGAGCCTTTTGCAAATCTTTCTGATTTGTTGGACAC
CTACTATAAGGATAAGGCTGAGCGCGACCGCGTCAAACAGCAGGCCAGTGAACTGATTCGTCGTGTTGA
AAATGAACTTCAGAAAAACCGACACAAACTCAAAAAACAGGAAAAAGAGTTACTGGCGACAGACAACGC
TGAAGAATTTCGTCAAAAAGGAGAATTGCTGACAACCTTCCTCCACCAAGTGCCTAACGACCAAGACCA
GGTTATCCTAGACAACTACTATACCAACCAACCTATCATGATTGCGCTTGATAAGGCTCTGATCCCAA
CCACAATGCCCAACGCTATTTTAAACGGTATCAGAAACTCAAAGAAGCTGTCAAATACTTGACTGATTT
GATGGAAGAAACCAAAGCCACTATTCTCTATCTGGAAAGTGTAGAAACCGTCCTCAACCAAGCTGGACT
GGAAGAAATCGCTGAAATCCGTGAAGAATTGATTCAAACAGGTTTTATCCGCAGAAGACAACGGGAGAA
AATCCAGAAACGCAAAAAACTAGAACAATATCTAGCAAGCGATGGCAAAACCATCATCTATGTCGGACG
AAACAATCTTCAAAATGAGGAATTGACCTTTAAAATGGCCCGCAAGGAGGAACTTTGGTTCCATGCTAA
GGACATTCTGGAAGCCATGTTGTCATCTCAGGAAATCTTGACCCATCTGATGCAGTCAAGACAGACGC
AGCAGAGTTAGCTGCCTACTTCTCTCAAGGGCGCCTGTCGAATCTGGTCAGGTAGATATGATTGAAGT
CAAAAAAACTCAATAAACCAACTGGTGGAAAACCCGGCTTTGTCACTTACACAGGACAAAAGACCCTCCG
CGTCACACCAGACTCCAAAAAAATTGCATCCATGAAAAAATCC SP039 amino acid (SEQ ID NO:60)
VLRKYLQGALIESIEQVENDRIVEITVSNKNEIGDHIQATLIIEIMGKHSNILLVDKSSHKILEVIKHV
GFSQNSYRTLLPGSTYIAPPSTKSLNPFTIKDEKLFEILQTQELTAKNLQSLFQGLGRDTANELERILV
SEKLSAFRNFFNQETKPCLTETSFSPVPFANQVGEPFANLSDLLDTYYKDKAERDRVKQQASELIRRVE
NELQKNRHKLKKQEKELLATDNAEEFRQKGELLTTFLHQVPNDQDQVILDNYYTNQPIMIALDKALTPN
QNAQRYFKRYQKLKEAVKYLTDLIEETKATILYLESVETVLNQAGLEEIAEIREELIQTGFIRRRQREK
IQKRKKLEQYLASDGKTIIYVGRNNLQNEELTFKMARKEELWFHAKDIPGSHVVISGNLDPSDAVKTDA
AELAAYFSQGRLSNLVQVDMIEVKKLNKPTGGKPGFVTYTGQKTLRVTPDSKKIASMKKS SP040 nucleotide (SEQ ID NO:61)
GACAACATTTACTATCCATACAGTAGAGTCAGCACCAGCAGAAGTGAAAGAAATTCTTGAAACAGTAGA
AAAAGACAACAATGGCTATATTCCCAACCTAATCGGTCTCTTGGCCAATGCCCCGACTGTTTTAGAAGC
CTACCAAATTGTCTCATCTATCCACCGTCGCAACAGCCTGACACCCGTTGAGCGTGAAGTGGTGCAAAT
CACGGCAGCCGTGACCAATGGTTGTGCCTTCTGTGTCGCAGGTCACACAGCCTTTTCCATCAAACAAAT
CCAGATGAATGATGACTTGATTCAAGCTCTTCGCAATCGTACTCCAATTGAAACAGATCCTAAATTGGA
TACCCTAGCTAAGTTTACCTTGGCAGTTATCAATACCAAGGGTCGTGTAGGAGATGAAGCCTTGTCTGA
CTTTTTTAGAAGCTGGCTACACTCAACAAAATGCCTTGGATGTGGTTTTTGGTGTCAGCCTAGCAATCCT
GTGTAACTATGCCAACAACTTAGCTAATACACCAATTAATCCAGAATTGCAACCTTATGCC SP040 amino acid (SEQ ID NO:62)
TIFTIHTVESAPAEVKEILETVEKDNNGYIPNLIGLLANAPTVLEAYQIVSSIHRRNSLTPVEREVVQI
TAAVTNGCAFCVAGHTAFSIKQIQMNDDLIQALRNRTPIETDPKLDTLAKFTLAVINTKGRVGDEALSE
FLEAGYTQQNALDVVFGVSLAILCNYANNLANTPINPELQPYA SP041 nucleotide (SEQ ID NO:63)
GGCTAAGGAAAGAGTGGATGTACTAGCTTATAAACAGGGGTTGTTTGAAACGAGAGAGCAGGCCAAGCG
AGGTGTGATGGCTGGCCTAGTCGTAGCAGTCCTTAATGGAGAACGGTTTGACAAGCCAGGAGAGAAAAT
TCCAGATGACACCGCAATTAAAACTCAAGGGGGAGAAACTCAAGTATGTCAGCCGTGCTGGTTTGAACT
GGAAAAGGCCTTGCAGGTCTTTGATTTGTCGGTGGATGGCGCGACTACGATTGATATCGGGGCCTCTAC
TGGAGGTTTTACCGATGTCATGCTACAGAATAGTGCCAAGTTGGTCTTTGCAGTCGATGTTGGTACCAA
TCAGTTGGCTTGGAAATTACGCCAAGACCCACGAGTTGTCAGCATGGAGCAGTTCAATTTCCGCTATGC
TGAAAAGACTGATTTCGAGCAGGAGCCGAGCTTTGCCAGTATTGATGTGAGTTTCATTTCCCTTAGTCT
GATTTTGCCAGCCTTGCACCGTGTCTTGGCTGATCAAGGTCAGGTGGTAGCACTTGTCAAACCTCAGTT
TGAGGCAGGACGTGAGCAGATTGGGAAAAATGGAATTATTCGAGATGCTAAGGTTCATCAGAATGTCCT
TGAATCTGTAACAGCTATGGCAGTAGAGGTAGGTTTTTCAGTCCTTGGCTTGGACTTTTCTCCCATCCA
AGGTGGACATGGAAATATTGAATTTTTTAGCGTATTTGAAAAAAGAAAAGTCAGCAAGCAATCAGATTCT
TGCTGAGATTAAAGAAGCAGTAGAGAGGGCGCATAGTCAATTTAAAAATGAA SP041 amino acid (SEQ ID NO:64)
AKERVDVLAYKQGLFETREQAKRGVMAGLVVAVLNGERFDKPGEKIPDDTELKLKGEKLKYVSRGGLKL
EKALQVFDLSVDGATTIDIGASTGGFTDVMLQNSAKLVFAVDVGTNQLAWKLRQDPRVVSMEQFNFRYA
EKTDFEQEPSFASIDVSFISLSLILPALHRVLADQGQVVALVKPQFEAGREQIGKNGIIRDAKVHQNVL
ESVTAMAVEVGFSVLGLDFSPIQGGHGNIEFLAYLKKEKSASNQILAEIKEAVERAHSQFKNE SP042 nucleotide (SEQ ID NO:65)
TTGTTCCTATGAACTTGGTCGTCACCAAGCTGGTCAGGTTAAGAAAGAGTCTAATCGAGTTTCTTATAT
AGATGGTGATCAGGCTGGTCAAAAGGCAGAAAACTTGACACCAGATGAAGTCAGTAAGAGGGAGGGGAT
CAACGCCGAACAAATNGTNATCAAGATTACGGATCAAGGTTATGTGACCTCTCATGGAGACCATTATCA
TTACTATAATGGCAAGGTTCCTTATGATGCCATCATCAGTGAAGAGCTCCTCATGAAAGATCCGAATTA TABLE 1-continued

```
TCAGTTGAAGGATTGAGACATTGTCAATGAAATCAAGGGTGGTTATGTCATTAAGGTAAACGGTAAATA
CTATGTNTACCTTAAGGATGCAGCTCATGCGGATAATATTCGGACAAAAGAAGAGATTAAACGTCAGAA
GCAGGAACGCAGTCATAATCATAACTCAAGAGCAGATAATCGTGTTGCTGCAGCCAGAGCCCAAGGACG
TTATACAACGGATGATGGGTATATCTTCAATGCATCTGATATCATTGAGGACACGGGTGATGCTTATAT
CGTTCCTCACGGCGACCATTACCATTACATTCCTAAGAATGAGTTATCAGCTAGCGAGTTAGCTGCTGC
AGAAGCCTATTGGAATGGGAAGCAGGGATCTCGTCCTTCTTCAAGTTCTAGTTATAATGCAAATCCAGC
TCAACCAAGATTGTCAGAGAACCACAATCTGACTGTCACTCCAACTTATCATCAAAATCAAGGGGAAAA
CATTTCAAGCCTTTTACGTGAATTGTATGCTAAACCCTTATCAGAACGCCATGTGGAATCTGATGGCCT
TATTTTCGACCCAGCGCAAATCACAAGTCGAACCGCCAGAGGTGTAGCTGTCCCTCATGGTAACCATTA
CCACTTTATCCCTTATGAACAAATGTCTGAATTGGAAAAACGAATTGCTCGTATTATTCCCCTTCGTTA
TCGTTCAAACCATTGGGTACCAGATTCAAGACCAGAACAACCAAGTCCACAATCGACTCCGGAACCTAG
TCCAAGTCCGCAACCTGCACCAAATCCTCAACCAGCTCCAAGCAATCCAATTGATGAGAAATTGGTCAA
AGAAGCTGTTCGAAAAGTAGGCGATGGTTATGTCTTTGAGGAGAATGGAGTTTCTCGTTATATCCCAGC
CAAGGATCTTTCAGCAGAAACACCAGCAGGCATTGATAGCAAACTGGCCAAGCAGGAAAGTTTATCTCA
TAAGCTAGGAGCTAAGAAAACTGACCTCCCATCTAGTGATCGAGAATTTTACAATAAGGCTTATGACTT
ACTAGAAAGAATTCACCAAGATTTACTTGATAATAAAGGTCGACAAGTTGATTTTGAAGCTTTGGATAA
CCTGTTGGAACGACTCAAGGATGTCNCAAGTGATAAAGTCAAGTTAGTGGANGATATTCTTGCCTTCTT
AGCTCCGATTCGTCATCCAGAACGTTTAGGAAAACCAAATGCGCAAATTACCTACACTGATGATGAGAT
TCAAGTAGCCAAGTTGGCAGGCAAGTACACAACAGAAGCGGTTATATCTTTGATCCTCGTGATATAAC
CAGTGATGAGGGGATGCCTATGTAACTCCACATATGACCCATAGCCACTGGATTAAAAAAGATAGTTT
GTCTGAAGCTGAGAGAGCGGCAGCCCAGGCTTATGCTAAAGAGAAAGGTTTGACCCCTCCTTCGACAGA
CCATCAGGATTCAGGAAATACTGAGGCAAAAGGAGCAGAAGCTATCTACAACCGCGTGAAAGCAGCTAA
GAAGGTGCCACTTGATCGTATGCCTTACAATCTTCAATATACTGTAGAAGTCAAAAACGGTAGTTTAAT
CATACCTCATTATGACCATTACCATAACATCAAATTTGAGTGGTTTGACGAAGGCCTTTATGAGGCACC
TAAGGGGTATACTCTTGAGGATCTTTTGGCGACTGTCAAGTACTATGTCGAACATCCAAACGAACGTCC
GCATTCAGATAATGGTTTTGGTAACGCTAGCGACCATGTTCAAAGAAACAAAAATGGTCAAGCTGATAC
CAATCAAACGGAAAAACCAAGCGAGGAGAAACCTCAGACAGAAAAACCTGAGGAAGAAACCCCTCGAGA
AGAGAAACCGCAAAGCGAGAAACCAGAGTCTCCAAAACCAACAGAGGAACCAGAAGAATCACCAGAGGA
ATCAGAAGAACCTCAGGTCGAGACTGAAAAGGTTGAAGAAAAACTGAGAGAGGCTGAAGATTTACTTGG
AAAAAATCCAGGAT

SP042 amino acid (SEQ ID NO:66)
CSYELGRHQAGQVKKESNRVSYIDGDQAGQKAENLTPDEVSKREGINAEQXVIKITDQGYVTSHGDHYH
YYNGKVPYDAIISEELLMKDPNYQLKDSDIVNEIKGGYVIKVNGKYYVYLKDAAHADNIRTKEEIKRQK
QERSHNHNSRADNAVAAARAQGRYTTDDGYIFNASDIIEDTGDAYIVPHGDHYHYIPKNELSASELAAA
EAYWNGKQGSRPSSSSSYNANPAQPRLSENHNLTVTPTYHQNQGENISSLLRELYAKPLSERHVESDGL
IFDPAQITSRTARGVAVPHGNHYHFIPYEQMSELEKRIARIIPLRYRSNHWVPDSRPEQPSPQSTPEPS
PSPQPAPNPQPAPSNPIDEKLVKEAVRKVGDGYVFEENGVSRYIPAKDLSAETAAGIDSKLAKQESLSH
KLGAKKTDLPSSDREFYNKAYDLLARIHQDLLDNKGRQVDFEALDNLLERLKDVXSDKVKLVXDILAFL
APIRHPERLGKPNAQITYTDDEIQVAKLAGKYTTEDGYIFDPRDITSDEGDAYVTPHMTHSHWIKKDSL
SEAERAAAQAYAKEKGLTPPSTDHQDSGNTEAKGAEAIYNRVKAAKKVPLDRMPYNLQYTVEKNGSLI
IPHYDHYHNIKFEWFDEGLYEAPKGYTLEDLLATVKYYVEHPNERPHSDNGFGNASDHVQRNKNGQADT
NQTEKPSEEKPQTEKPEEETPREEKPQSEKPESPKPTEEPEESPEESEEPQVETEKVEEKLREAEDLLG
KIQD SP043 nucleotide (SEQ ID NO:67)
TTATAAGGGTGAATTAGAAAAAGGATACCAATTTGATGGTTGGGAAATTTCTGGTTTCGAAGGTAAAAA
AGACGCTGGCTATGTTATTAATCTATCAAAAGATACCTTTATAAAACCTGTATTCAAGAAAATAGAGGA
GAAAAAGGAGGAAGAAAATAAACCTACTTTTGATGTATCGAAAAAAGAAGATAACCCACAAGTAAACCA
TAGTCAATTAAATGAAAGTCACAGAAAAGAGGATTTACAAAGAGAAGAGCATTCACAAAAATCTGATTC
AACTAAGGATGTTACAGCTACAGTTCTTGATAAAAACAATATCAGTAGTAAATCAACTACTAACAATCC
TAATAAG SP043 amino acid (SEQ ID NO:68)
YKGELEKGYQFDGWEISGFEGKKDAGYVINLSKDTFIKPVFKKIEEKKEEENKPTFDVSKKKDNPQVNH
SQLNESHRKEDLQREEHSQKSDSTKDVTATVLDKNNISSKSTTNNPNK SP044 nucleotide (SEQ ID NO:69)
GAATGTTCAGGCTCAAGAAAGTTCAGGAAATAAAATCCACTTTATCAATGTTCAAGAAGGTGGCAGTGA
TGCGATTATTCTTGAAAGCAATGGACATTTTGCCATGGTGGATACAGGAGAAGATTATGATTTCCCAGA
TGGAAGTGATTCTCGCTATCCATGGAGAGAAGGAATTGAAACGTCTTATAAGCATGTTCTAACAGACCG
TGTCTTTCGTCGTTGAAGGAATTGGGTGTCCAAAAACTTGATTTTATTTTGGTGACCCATACCCACAG
TGATCATATTGGAAATGTTGATGAATTACTGTCTACCTATCCAGTTGACCGAGTCTATCTTAAGAAATA
TAGTGATAGTCGTATTACTAATTCTGAACGTCTATGGGATAATCTGTATGGCTATGATAAGGTTTTACA
GACTGCTGCAGAAAAAGGTGTTTCAGTTATTCAAAATATCACACAAGGGGATGCTCATTTTCAGTTTGG
GGACATGGATATTCAGCTCTATAATTATGAAAATGAAATTGGAATTAAAGAAAATTTG
GGATGACAATTCCAATTCCTTGATTAGCGTGGTGAAAGTCAATGGCAAGAAAATTTACCTTGGGGCGA
TTTAGATAATGTTCATGGAGCAGAAGACAAGTATGGTCCTCTCATTGGAAAAGTTGATTTGATGAAGTT
TAATCATCACCATGATACCAACAAATCAAATACCAAGGATTTCATTAAAAATTTGAGTCCGAGTTTGAT
TGTTCAAACTTCGGATAGTCTACCTTGGAAAAATGGTGTTGATAGTGATGTATTAATTGGCTCAAAGA
ACGAGGAATTGAGAGAATCAACGCAGCCAGCAAAGACTATGATGCAACAGTTTTTGATATTCGAAAAGA
CGGTTTTGTCAATATTCAACATCCTACAAGCCGATTCCAAGTTTTCAAGCTGGTTGCATAAGAGTGC
ATATGGGAACTGGTGGTATCAAGCGCCTGATTCTACAGGAGAGTATGCTGTCGGTTGGAATGAAATCGA
AGGTGAATGGTATTACTTTAACCAAACGGGTATCTTGTTACAGAATCAATGGAAAAAATGGAACAATCA
TTGGTTCTATTTGACAGACTCTGGTGCTTCTGCTAAAAATTGGAAGAAAATCGCTGGAATCTGGTATTA
TTTTAACAAAGAAACCAGATGGAAATTGGTTGGATTCAAGATAAAGAGCAGTGGTATTATTGGATGT
TGATGGTTCTATGAAGACAGGATGGCTTCAATATATGGGCAATGGTATTACTTTGCTCCATCAGGGGA
A
```

TABLE 1-continued

SP044 amino acid (SEQ ID NO:70)
NVQAQESSGNKIHFINVQEGGSDAIILESNGHFAMVDTGEDYDFPDGSDSRYPWREGIETSYKHVLTDR
VFRRLKELGVQKLDFILVTHTHSDHIGNVDELLSTYPVDRVYLKKYSDSRITNSERLWDNLYGYDKVLQ
TAAEKGVSVIQNITQGDAHFQFGDMDIQLYNYENETDSSGELKKIWDDNSNSLISVVKVNGKKIYLGGD
LDNVHGAEDKYGPLIGKVDLMKFNHHHDTNKSNTKDFIKNLSPSLIVQTSDSLPWKNGVDSEYVNWLKE
RGIERINAASKDYDATVFDIRKDGFVNISTSYKPIPSFQAGWHKSAYGNWWYQAPDSTGEYAVGNNEIE
GEWYYFNQTGILLQNQWKKWNNHWFYLTDSGASAKNWKKIAGIWYYFNKENQMEIGWIQDKEQWYYLDV
DGSMKTGLQYMGQWYYFAPSGE SP045 nucleotide (SEQ ID NO:71)
CTTGGGTGTAACCCATATCCAGCTCCTTCCAGTCTTGTCTTACTACTTTGTCAATGAATTGAAAAACCA
TGAACGCTTGTCTGACTACGCTTCAAGCAACAGCAACTACAACTGGGGATATGACCCTCAAAACTACTT
CTCCTTGACTGGTATGTACTCAAGCGATCCTAAGAATCCAGAAAAACGAATCGCAGAATTTAAAAACCT
CATCAACGAAATCCACAAACGTGGTATGGGAGCTATCCTAGATGTCGTTTATAACCACACAGCCAAAGT
CGATCTCTTTGAAGATTTGGAACCAAACTACTACCACTTTATGGATGCCGATGGGACACCTCGAACTAG
CTTTGGTGGTGGACGCTTCGGGACAACCACCATATGACCAAACGGCTCCTAATTGACTCTATCAAATA
CCTAGTTGATACCTACAAAGTGGATGGCTTCCGTTTCGATATGATGGGAGACCATGACGCCGCTTCTAT
CGAAGAAGCTTACAAGGCTGCACGCGCCCTCAATCCAAACCTCATCATGCTTGGTGAAGGTTGGAGAAC
CTATGCCGGTGATGAAAACATGCCTACTAAAGCTGCTGACCAAGATTGGATGAAACATACCGATACTGT
CGCTGTCTTTTCAGATGACATCCGTAACAACCTCAAATCTGGTTATCCAAACGAAGGTCAACCTGCCTT
TATCACAGGTGGCAAGCGTGATGTCAACACCATCTTTAAAAATCTCATTGCTCAACCAACTAACTTTGA
AGCTGACAGCCCTGGAGATGTCATCCAATACATCGCAGCCCATGATAACTTGACCCTCTTTGACATCAT
TGCCCAGTCTATCAAAAAAGACCCAAGCAAGGCTGAGAACTATGCTGAAATCCACCGTCGTTTACGACT
TGGAAATCTCATGGTCTTGACAGCTCAAGGAACTCCATTTATCCACTCCGGTCAGGAATATGGACGTAC
TAAACAATTCCGTGACCCAGCCTACAAGACTCCAGTAGCAGAGGATAAGGTTCCAAACAAATCTCACTT
GTTGCGTGATAAGGACGGCAAGCCATTTGACTATCCTTACTTCATCCATGACTCTTACGATTCTAGTGA
TGCAGTCAACAAGTTTGACTGGACTAAGGCTACAGATGGTAAAGCTTATCCTGAAAATGTCAAGAGCCG
TGACTATATGAAAGGTTTGATTGCCCTTCGTCAATCTACAGATGCCTTCCGACTTAAGAGTCTTCAAGA
TATCAAAGACCGTGTCCACCTCATCACTGTCCCAGGCCAAAATGGTGTGGAAAAAGAGGATGTAGTGAT
TGGCTACCAAATCACTGCTCCAAACGGCGATATCTACGCAGTCTTTGTCAATGCGGATGAAAAAGCTCG
CGAATTTAATTTGGGAACTGCCTTTGCACATCTAAGAAATGCGGAAGTTTTGGCAGATGAAAACCAAGC
AGGACCAGTCGGAATTGCCAACCCGAAAGGACTTGAATGGACTGAAAAAGGCTTGAAATTGAATGCCCT
TACAGCTACTGTTCTTCGAGTCTCTCAAAATGGAACTAGCCATGAGTCTACTGCAGAAGAGAAACCAGA
CTCAACCCCTTCCAAGCCTGAACATCAAAATGAAGCTTCTCACCCTGCACATCAAGACCCAGCTCCAGA
AGCTAGACCTGATTCTACTAAACCAGATGCCAAAGTAGCTGATGCGGAAAATAAACCTAGCCAAGCTAC
AGCTGATTCACAAGCTGAACAACCAGCACAAGAAGCACAAGCATCATCTGTAAAAGAAGCGGTTCGAAA
CGAATCGGTAGAAAACTCTAGCAAGGATATACCTGCAACCCCAGATAAACAAGCTGAA SP045 nucleotide (SEQ ID NO:72)
LGVTHIQLLPVLSYYFVNELKNHERLSDYASSNSNYNWGYDPQNYFSLTGMYSSDPKNPEKRIAEFKNL
INEIHKRGMGAILDVVYNHTAKVDLFEDLEPNYYHFMDADGTPRTSFGGGRLGTTHHMTKRLLIDSIKY
LVDTYKVDGFRFDMMGDHDAASIEEAYKAARALNPNLIMLGEGWRTYAGDENMPTKAADQDWMKHTDTV
AVFSDDIRNNLKSGYPNEGQPAFITGGKRDVNTIFKNLIAQPTNFEADSPGDVIQYIAAHDNLTLFDII
AQSIKKDPSKAENYAEIHRRLRLGNLMVLTAQGTPFIHSGQEYGRTKQFRDPAYKTPVAEDKVPNKSHL
LRDKDGNPFDYPYFIHDSYDSSDAVNKFDWTKATDGKAYPENVKSRDYMKGLIALRQSTDAFRLKSLQD
IKDRVHLITVPGQNGVEKEDVVIGYQITAPNGDIYAVFVNADEKAREFNLGTAFAHLRNAEVLADENQA
GPVGIANPKGLEWTEKGLKLNALTATVLRVSQNGTSHESTAEEKPDSTPSKPEHQNEASHPAHQDDAPE
ARPDSTKPDAKVADAENKPSQATADSQAEQPAQEAQASSVKEAVRNESVENSSKENIPATPDKQAE SP046 nucleotide (SEQ ID NO:73)
TAGTGATGGTACTTGGCAAGGAAAACAGTATCTGAAAGAAGATGGCAGTCAAGCAGCAAATGAGTGGGT
TTTNGATACTCATTATCAATCTTGGTTCTATATAAAAGCAGATGCTAACTATGCTGAAAATGAATGGCT
AAAGCAAGGTGACGACTATTTTTACCTCAAATCTGGTGGCTATATGGCCAAATCAGAATGGGTAGAAGA
CAAGGGAGCCTTTTATTATCTTGACCAAGATGGAAAGATGAAAAGAAATGCTTGGGTAGGAACTTCCTA
TGTTGGTGCAACAGGTGCCAAAGTAATAGAAGACTGGGTCTATGATTCTCAATACGATGCTTGGTTTTA
TATCAAAGCAGATGGACAGCACGCAGAGAAAGAATGGCTCCAAATTAAAGGGAAGGACTATTATTTCAA
ATCCGGTGGTTATCTACTGACAAGTCAGTGGATTAATCAAGCTTATGTGAATGCTAGTGGTGGCAAAGT
ACAGCAAGGTTGGCTTTTTGACAAACAATACCAATCTTGGTTTTACATCAAAGAAAATTGGAAACTATGC
TGATAAAGAATGGATTTTCGAGAATGGTCACTATTATTATCTAAAATCCGGTGGCTACATGGCAGCCAA
TGAATGGATTTGGGATAAGGAATCTTGGTTTTACCTCAAATCTGATGGGAAAATAGCTGAAAAAGAATG
GGTCTACGATTCTCATAGTCAAGCTTGGTACTACTTCAAATCCGGTGGTTACATGACAGCCAATGAATG
GATTTGGGATAAGGAATCTTGGTTTTACCTCAAATCTGATGGGAAAATAGCTGAAAAAGAATGGGTCTA
CGATTCTCATAGTCAAGCTTGGTACTACTTCAAATCTGGTGGCTACATGGCGAAAATGAGACAGTAGA
TGGTTATCAGCTTGGAAGCGATGGTAAATGGCTTGGAGGAAAAACTACAAATGAAATGCTGCTTACTA
TCAAGTAGTGCCTGTTACAGCCAATGTTTATGATTCAGATGGTGAAAAGCTTTCCTATATATCGCAAGG
TAGTGTCGTATGCGTAGATAAGGATAGAAAAAGTGATGACGCGTTGGCTATTACTATTTCTGGTTT
GTCAGGCTATATGAAAACAGAAGATTTACAAGCGCTAGATGCTAGTAAGGACTTTATCCCTTATTATGA
GAGTGATGGCCACCGTTTTTATCACTATGTGGCTCAGAATGCTAGTATCCCAGTAGCTTCTCATCTTTC
TGATATGGAAGTAGGCAAGAAATATTATTCGGCAGATGGCCTGCATTTTGATGGTTTTAAGCTTGAGAA
TCCCTTCCTTTTCAAAGATTTAACAGAGGCTACAACTACAGTGCTGAGAATTGGATAAGGTATTTAG
TTTGCTAAACATTAACAATAGCCTTTTGGAGAACAAGGGCGCTACTTTTAAGGAAGCCGAAGAACATTA
CCATATCAATGCTCTTTATCTCCTTGCCCATAGTGCCCTAGAAATAACTGGGGAAGAAGTAAAATTGC
CAAAGATAAGAATAATTTCTTTGGCATTACAGCCTATGATACGACCCCTTACCTTTCTGCTAAGACATT
TGATGATGTGGATAAGGGAATTTTAGGTGCAACCAAGTGGATTAAGGAAAATTATATCGATAGGGGAAG
AACTTTCCTTGGAAACAAGGCTTCTGGTATGAATGTGGAATATGCTTCAGACCCTTATTGGGCGAAAAA
AATTGCTAGTGTGATGATGAAAATCAATGAGAAGCTAGGTGGCAAAGAT SP046 amino acid (SEQ ID NO:74)
SDGTWQGKQYLKEDGSQAANEWVXDTHYQSWFYIKADANYAENEWLKQGDDYFYLKSGGYMAKSEWVED TABLE 1-continued KGAFYYLDQDGKMKRNAWVGTSYVGATGAKVIEDWVYDSQYDAWFYIKADGQHAEKEWLQIKGKDYYFK
SGGYLLTSQWINQAYVNASGAKVQQGWLFDKQYQSWFYIKENGNYADKEWIFENGHYYYLKSGGYMAAN
EWIWDKESWFYLKFDGKMAEKEWVYDSHSQAWYYFKSGGYMTANEWIWDKESWFYLKSDGKIAEKEWVY
DSHSQAWYYFKSGGYMAKNETVDGYQLGSDGKWLGGKTTNENAAYYQVVPVTANVYDSDGEKLSYISGG
SVVWLDKDRKSDDKRLAITISGLSGYMKTEDLQALDASKDFIPYYESDGHRFYHYVAQNASIPVASHLS
DMEVGKKYYSADGLHFDGFKLENPFLFKDLTEATNYSAEELDKVFSLLNINNSLLENKGATFKEAEEHY
HINALYLLAHSALESNWGRSKIAKDKNNFFGITAYDTTPYLSAKTFDDVDKGILGATKWIKENYIDRGR
TFLGNKASGMNVEYASDPYWGEKIASVMMKINEKLGGKD SP048 nucleotide (SEQ ID NO:75)
TGGGATTCAATATGTGAGAGATGATACTAGAGATAAAGAAGAGGGAATAGAGTATGATGACGCTGACAA
TGGGGATATTATTGTAAAAGTAGCGACTAAACCTAAGGTAGTAACCAAGAAAAATTTCAAGTACGCGAAT
TCGTTATGAAAAAGATGAAACAAAAGACCGTAGTGAAAATCCTGTTACAATTGATGGAGAGGATGGCTA
TGTAACTACGACAAGGACCTACGATGTTAATCCAGAGACTGGTTATGTTACCGAACAGGTTACTGTTGA
TAGAAAAGAAGCCACGGATACAGTTATCAAAGTTCCAGCTAAAAGCAAGGTTGAAGAAGTTCTTGTTCC
ATTTGCTACTAAATATGAAGCAGACAATGACCTTTCTGCAGGCACAGGAGCAAGAGATTACTCTAGGAAA
GAATGGGAAAACAGTTACAACGATAACTTATAATGTAGATGGAAAGAGTGGACAAGTAACTGAGAGTAC
TTTAAGTCAAAAAAAGACTCtCAAACAAGAGTTGTTAAAAAAAGaACCArkCCCCAAGTTCTTGTCCA
AGAAATTCCAATCGAAACAGAATATCTCGATGGCCCaACTCTTGATAAAgTCAAGAAGTAGAAGAAGT
AGGAGAAATTGGTAAATTACTCTTACTACAATCTATACTGGTAGATGAACGTGATGGAACAATTGAAGA
AACTACTTCTCGTCAAATTACTAAAGAGATGGTAAAAAGACGTATAAGGAGAGGGACGAGAGAACCTGA
AAAAGTTGTTGTTCCTGAGCAATCATCTATTCCTTCGTATCCTGTATCTGTTACATCTAACCAAGGAAC
AGATGTAGCAGTAGAACCAGCTAAAGCAGTTGCTCCAACAACAGACTGGAAACAAGAAAATGGTATGTG
GTATTTTTATAATACTGATGGTTCCATGGCAACAGGTTGGGTACAAGTTAATAGTTCATGGTACTACCT
CAACAGCAACGGTTCTATGAAAGTCAATCAATGGTTCCAAGTTGGTGGTAAATGGTATTATGTAAATAC
ATCGGGTGAGTTAGCGGTCAATACAAGTATAGATGGCTATAGAGTCAATGATAATGGTGAATGGGTGCG
T SP048 amino acid (SEQ ID NO:76)
GIQYVRDDTRDKEEGIEYDDADNGDIIVKVATKPKVVTKKISSTRIRYEKDETKDRSENPVTIDGEDGY
VTTTRTYDVNPETGYVTEQVTVDRKEATDTVIKVPAKSKVEEVLVPFATKYEADNDLSAGQEQEITLGK
NGKTVTTITYNVDGKSGQVTESTLSQKKDSQTRVVKKRTXPQVLVQEIPIETEYLDGPTLDKSQEVEEV
GEIGKLLLLQSILVDERDGTIEETTSRQITKEMVKRRIRRGTREPEKVVVPEQSSIPSYPVSVTSNQGT
DVAVEPAKAVAPTTDWKQENGMWYFYNTDGSMATGWVQVNSSWYYLNSNGSMKVNQWFQVGGKWYYVNT
SGELAVNTSIDGYRVNDNGEWVR SP049 nucleotide (SEQ ID NO:77)
GGATAATAGAGAAGCATTAAAAACCTTTATGACGGGTGAAAATTTTTATCTCCAACATTATCTAGGAGC
ACATAGGGAAGAACTAAATGGAGAGCATGGCTATACCTTCCGTGTTTGGGCACCTAATGCTCAGGCTGT
TCACTTGGTTGGTGATTTTACCAACTGGATTGAAAATCAGATTCCAATGGTAAGAAATGATTTTGGGGT
CTGGGAAGTCTTTACCAATATGGCTCAAGAAGGGCATATTTACAAATATCATGTCACACGTCAAATGG
TCATCAACTGATGAAGATTGACCCTTTTGCTGTCAGGTATGAGGCTCGTCCAGGAACAGGGGCAATCGT
AACAGAGCTTCCTGAGAAGAAATGGAAGGATGGACTTTGGCTGGCACGAAGAAAACGTTGGGGCTTTGA
AGAGCGTCCTGTCAATATTTATGAAGTTCACGCTGGATCATGGAAAAGAAATTCTGATGGCAGTCCTTA
TAGTTTTGCCCAGCTCAAGGATGAACTCATTCCTTATCTCGTTGAAATGAACTATACTCATATTGAGTT
TATGCCCTTGATGTCCCATCCTTTGGGCTTGAGTTGGGGGTATCAGCTTATGGGTTACTTCGCTTTAGA
GCATGCTTATGGCCGACCAGAGGAGTTTCAAGATTTTGTC SP049 amino acid (SEQ ID NO:78)
DNREALKTFMTGENFYLQHYLGAHREELNGEHGYTFRVWAPNAQAVHLVGDFTNWIENQIPMVRNDFGV
WEVFTNMAQEGHIYKYHVTRQNGHQLMKIDPFAVRYEARPGTGAIVTELPEKKWKDGLWLARRKRWGFE
ERPVNIYEVHAGSWKRNSDGSPYSFAQLKDELIPYLVEMNYTHIEFMPLMSHPLGLSWGYQLMGYFALE
HAYGRPEEFQDFV SP050 nucleotide (SEQ ID NO:79)
AGATTTTGTCGAGGAGTGTCATACCCATAATATTGGGGTTATTGTGGACTGGGTACCAGNTCACTTTAC
CATCAACGATGATGCCTTAGCCTATTATGATGGGACACCGACTTTTGAATACCAAGACCATAATAAGGC
TCATAACCATGGTTGGGGTGCCCTTAATTTTGACCTTGGAAAAAATGAAGTCCAGTCCTTCTTAATTTC
TTGCATTAAGCATTGGATTGATGTCTATCATTTGGATGGTATTCGTGTGGATGCTGTTAGCAACATGCT
CTATTTGGACTATGATGATGCTCCATGGACACCTAATAAAGATGGCGGAAATCTCAACTATGAAGGTTA
TTATTTCCTTCAGGGCTTGAATGAGGTTATTAAGTTAGAATATCCAGATGTGATGATGATTGCAGAAGA
AAGTTCGTCTGCGATCAAGATTACGGGAATGAAAGAGATTGGTGGTCTAGGATTTGACTACAAATGGAA
CATGGGCTGGATGAATGATATCCTCCGTTTCTACGAAGAAGATCCGATCTATCGTAAATATGACTTTAA
CCTGGTGACTTTCAGCTTTATGTATGTTTNCAAGGAGAATTATCTCTTGCCATTCTCGCACGATGAAGT
GGGTTCATGGCAAGAAGAGTATGATGCATAAGATGTGGGAGATCGTTACAATCAATTCGCAGGCTTGCG
CAATCCTCTATACGTACCAAATTTGTCACCCTGGTAAGAAATTGCTCTTCATGGGTAGCGAATACGGTCA
ATTCCTAGAATGGAAATCTGAAGAACAGTTGGAATGGTCTAACCTAGAAGACCCAATGAATGCTAAGAT
GAAGTATTTCGCTTCTCAGCTAAACCAGTTTTACAAAGATCATCGCTGTCTGTGGGAAATTGATACCAG
CTATGATGGTATTGAAATCATTGATGCGGATAATCGAGACCAGAGTGTTCTTTCCTTTATTCGTAAGGG
TAAAAAGGGA SP050 amino acid (SEQ ID NO:80)
DFVEECHTHNIGVIVDWVPXHFTINDDALAYYDGTPTFEYQDHNKAHNHGWGALNFDLGKNEVQSFLIS
CIKHWIDVYHLDGIRVDAVSNMLYLDYDDAPWTPNKDGGNLNYEGYYFLQRLNEVIKLEYPDVMMIAEE
SSSAIKITGMKEIGGLGFDYKWNMGWMNDILRFYEEDPIYRKYDFNLVTFSFMYVKENYLLPFSHDEV
VHGKKSMMHKMWGDRYNQFAGLRNLYTYQICHPGKKLLFMGSEYGQFLEWKSEEQLEWSNLEDPMNAKM
KYFASQLNQFYKDHRCLWEIDTSYDGIEIIDADNRDQSVLSFIRKGKKG SP051 nucleotide (SEQ ID NO:81)

TABLE 1-continued

```
ATCTCTAGTTTATGCGGATGAAACACTTATTACTCATACTGCTGAGAAACCTAAAGAGGAAAAAATGAT
AGTAGAAGAAAAGGCTGATAAAGCTTTGGAAACTAAAAATATAGTTGAAAGGACAGAACAAAGTGAACC
TAGTTCAACTGAGGCTATTGCATCTGAGNAGAAAGAAGATGAAGCCGTAACTCCAAAAGAGGAAAAAGT
GTCTGCTAAACCGGAAGAAAAAGCTCCAAGGATAGAATCAAGCTTCAAATGAAGAAAACCGCTCAA
GGAAGATGCTAAAGCTGTAACAAATGAAGAAGTGAATCAAATGATTGAAGACAGGAAAGTGGATTTTAA
TCAAAATTGGTACTTTAAACTCAATGCAAATTCTAAGGAAGCCATTAAACCTGATGCAGACGTATCTAC
GTGGAAAAAATTAGATTTACCGTATGACTGGAGTATCTTTAACGATTTCGATCATGAATCTCCTGCACA
AAATGAAGGTGGACAGCTCAACGGTGGGGAAGCTTGGTATCGCAAGACTTTCAAACTAGATGAAAAAGA
CCTCAAGAAAAATGTTCGCCTTACTTTTGATGGCGTCTACATGGATTCTCAAGTTTATGTCAATGGTCA
GTTAGTGGGCATTATGCAAATGGTTATAACCAGTTCTCATATGATATCACCAAATACCTTCAAAAAGA
TGGTCGTGAGAATGTGATTGCTGTCCATGCAGTCAACAAACAGCCAAGTAGCCGTTGGTATTCAGGAAG
TGGTATCTATCGTGATCTGACTTTACAAGTGACAGATAAGCTCCATGTTGAGAAAAATGGGACAACTAT
TTTAACACCAAAACTTGAAGAACAACAACATGGCAAGGTTGAAACTCATGTGACCAGCAAAATCGTCAA
TACGGACGACAAAGACCATGAACTTGTAGCCGAATATCAAATCGTTGAACGAGGTGGTCATGCTGTAAC
AGGCTTAGTTCGTACAGCGAGTCGTACCTTAAAAGCACATGAATCAACAAGCCTAGATGCGATTTTAGA
AGTTGAAAGACCAAAACTCTGGACTGTTTTAAATGACAAACCTGCCTTGTACGAATTGATTACGCGTGT
TTACCGTGACGGTCAATTGGTTGATGCTAAGAAGGATTTGTTTGGTTACCGTTACTATCACTGGACTCC
AAATGAAGGTTTCTCTTTGAATGGTGAACGTATTAAATTCCATGGAGTATCCTTGCACCACGACCATGG
GGCGCTTGGAGCAGAAGAAAACTATAAAGCAGAATATCGCCGTCTCAAACAAATGAAGGAGATGGGAGT
TAACTCCATCCGTACAACCCACAACCCTGCTAGTGAGCAAACCTTGCAAATCGCAGCAGAACTAGGTTT
ACTCGTTCAGGAAGAGGCCTTTGATACGTGGTATGGTGGCAAGAAACCTTATGACTATGGACGTTTCTT
TGAAAAAGATGCCACTCACCCAGAAGCTCGAAAAGGTGAAAATGGTCTGATTTTGACCTACGTACCAT
GGTCGAAAGAGGCAAAAACAACCCTGCTATCTTCATGTGGTCAATTGGTAATGAAATAGGTCAAGCTAA
TGGTGATGCCCACTCTTTAGCAACTGTTAAACGTTTGGTTAAGGTTATCAAGGATGTTGATAAGACTCG
CTATGTTACCATGGGAGCAGATAAATTCCGTTTCGGTAATGGTAGCGGAGGGCATGAGAAAATTGCTGA
TGAACTCGATGCTGTTGGATTTAACTATTCTGAAGATAATTACAAAGCCCTTAGAGCTAAGCATCCAAA
ATGGTTGATTTATGGATCAGAAACATCTTCAGCTACCCGTACACGTGGAAGTTACTATCGCCTGGACG
TGAATTGAAACATAGCAATGGACCTGAGCGTAATTATGAACAGTCAGATTATGGAAATGATCGTGTGGG
TTGGGGGAAAACAGCAACCGCTTCATGGACTTTTGACCGTGACAACGCTGGCTATGCTGGACAGTTTAT
CTGGACAGGTACGGACTATATTGGTGAACCTACACCATGGCACAACCAAATCAAACCTCCTGTTAAGAG
CTCTTACTTTGGTATCGTAGATACAGCCGGCATTCCAAAACATGACTTCTATCTCTACCAAAGC

SP051 amino acid (SEQ ID NO:82)
SVVYADETLITHTAEKPKEEKMIVEEKADKALETKNIVERTEQSEPSSTEAIASEXKEDEAVTPKEEKV
SAKPEEKAPRIESQASNQEKPLKEDAKAVTNEEVNQMIEDRKVDFNQNWYFKLNANSKEAIKPDADVST
WKKLDLPYDWSIFNDFDHESPAQNEGGQLNGGEAWYRKTFKLDEKDLKKNVRLTFDGVYMDSQVYVNGQ
LVGHYPNGYNQFSYDITKYLQKDGRENVIAVHAVNKQPSSRWYSGSGIYRDVTLQVTDKVHVEKNGTTI
LTPKLEEQQHGKVETHVTSKIVNTDDKDHELVAEYQIVERGGHAVTGLVRTASRTLKAHESTSLDAILE
VERPKLWTVLNDKPALYELITRVYRDGQLVDAKKDLFGYRYYHWTPNEGFSLNGERIKFHGVSLHHDHG
ALGAEENYKAEYRRLKQMKEMGVNSIRTTHNPASEQTLQIAAELGLLVQEEAFDTWYGGKKPYDYGRFF
EKDATHPEARKGEKWSDFDLRTMVERGKNNPAIFMWSIGNEIGEANGDAHSLATVKRLVKVIKDVDKTR
YVTMGADKFRFGNGSGGHEKIADELDAVGFNYSEDNYKALRAKHPKWLIYGSETSSATRTRGSYYRPER
ELKHSNGPERNYEQSDYGNDRVGWGKTATASWTFDRDNAGYAGQFIWTGTDYIGEPTPWHNQNQTPVKS
SYFGIVDTAGIPKHDFYLYQS SP052 nucleotide (SEQ ID NO:83)
TTACTTTGGTATCGTAGATACAGCCGGCATTCCAAAACATGACTTCTATCTCTACCAAAGCCAATGGGT
TTCTGTTAAGAAGAAACCGATGGTACACCTTCTTCCTCACTGGAACTGGGAAAACAAAGAATTAGCATC
CAAAGTAGCTGACTCAGAAGGTAAGATTCCAGTTCGTGCTTATTCGAATGCTTCTAGTGTAGAATTGTT
CTTGAATGGAAAATCTCTTGGTCTTAAGACTTTCAATAAAAAACAAACCAGCGATGGGCGGACTTACCA
AGAAGGTGCAAATGCTAATGAACTTTATCTTGAATGGAAAGTTGCCTATCAACCAGGTACCTTGGAAGC
AATTGCTCGTGATGAATCTGGCAAGGAAATTGCTCGAGATAAGATTACGACTGCTGGTAAGCCACCGGC
AGTTCGTCTTATTAAGGAAGACCATGCGATTGCAGCAGATGAAAAGACTTGACTTACATCTACTATGA
AATTGTTGACAGCCAGGGGAATGTGGTTCCAACTGCTAATAATCTGCGCTTCCAATTGGATGGCCA
AGGTCAACTGGTCGGTGTAGATAACGGAGAACAAGCCAGCCGTGAACGCTATAAGGCGCAAGCAGATGG
TTCTTGGATTCGTAAAGCATTTAATGGTAAAGGTGTTGCCATTGTCAAATCAACTGAACAAGCAGGGAA
ATTCACCCTGACTGCCCACTCTGATCTCTTGAAATCGAACCAAGTCACTGTCTTTACTGGTAAGAAAGA
AGGACAAGAGAAGACTGTTTTGGGGACAGAAGTGCCAAAAGTACAGACCATTATTGGAGAGGCACCTGA
AATGCCTACCACTGTTCCGTTTGTATACAGTGATGGTAGCCGTGCAGAACGTCCTGTAACCTGGTCTTC
AGTAGATGTGAGCAAGCCTGGTATTGTAACGGTGAAAGGTATGGCTGACGGACGACAAGTAGAAGCTCG
TGTAGAAGTGATTGCTCTTAAATCAGAGCTACCAGTTGTGAAACGTATTGCTCCAAATACTGACTTGAA
TTCTGTAGACAAATCTGTTTCCTATGTTTTGATTGATGGAAGTGTTGAAGATGTATGAAGTGGACAAGTG
GGAGATTGCCGAAGAAGATAAAGCTAACTTAGCAATTCCAGGTTCTCGTATTCAAGCGACCGGTTATTT
AGAAGGTCAACCAATTCATGCAACCCTTGTGGTAGAAGAAGGCAATCCTGCGGCACCTGCAGTACCAAC
TGTAACGGTTGGTGGTGAGGCAGTAACAGGTCTTACTAGTCAAAAACCAATGCAATACCGCACTCTTGC
TTATGAGCTAAGTTGCCAGAAGTCACAGCAAGTGCTAAAAATGCAGTGTTTACAGTTCTTCAAGCAAG
CGCAGCAAACGGCATGCGTGCGAGCATCTTTATTGAGCCTAAAGATGGTGGCCCTCTTCAAACCTATGC
AATTCAATTCCTTGAAGAAGCGCCAAAAATTGCTCACTTGAGCTTGCAAGTGGAAAAGCTGACAGTCT
CAAAGAAGACCAAACTGTCAAATTGTCGGTTCGAGCTCACTATCAAGATGGAACGCAAGCTGTATTACC
AGCTGATAAAGTAACCTTCTCTACAAGTGGTGAAGGGGAAGTCGCAATTCGTAAAGGAATGCTTGAGTT
GCATAAGCCAGGAGCAGTCACTCTGAACGCTGAATATGAGGGAGCTAAAGACCAAGTTGAACTCACTAT
CCAAGCCAATACTGAGAAGAAGATTGCGCAATCCATCCGTCCTGTAAATGTAGTGACAGATTTGCATCA
GGAACCAAGTCTTCCAGCAACAGTAACAGTTGAGTATGACAAAGGTTTCCCTAAAACTCATAAAGTCAC
TTGGCAAGCTATTCCGAAAGAAAAACTAGACTCCTATCAAACATTTGAAGTACTAGGTAAAGTTGAAGG
AATTGACCTTGAAGCGCGTGCAAAAGTCTGTGTAGAAGGTATCGTTTCAGTTGAAGAAGTCAGTGTGAC
AACTCCAATCGCAGAAGCACCACAATTACCAGAAAGTGTTCGGACATATATGATTCAAATGGTCACGTTTC
ATCAGCTAAGGTTGCATGGGATGCGATTCGTCCAGAGCAATACGCTAAGGAAGGTGTCTTTACAGTTAA
TGGTCGCTTAGAAGGTACGCAATTAACA
```

TABLE 1-continued

SP052 amino acid (SEQ ID NO:84)
YFGIVDTAGIPKHDFYLYQSQWVSVKKKPMVHLLPHWNWENKELASKVADSEGKIPVRAYSNASSVELF
LNGKSLGLKTFNKKQTSDGRTYQEGANANELYLEWKVAYQPGTLEAIARDESGKEIARDKITTAGKPAA
VRLIKEDHAIAADGKDLTYIYYEIVDSQGNVVPTANNLVRFQLHGQGQLVGVDNGEQASRERYKAQADG
SWIRKAFNGKGVAIVKSTEQAGKFTLTAHSDLLKSNQVTVFTGKKEGQEKTVLGTEVPKVQTIIGEAPE
MPTTVPFVYSDGSRAERPVTWSSVDVSKPGIVTVKGMADGREVEARVEVIALKSELPVVKRIAPNTDLN
SVDKSVSYVLIDGSVEEYEVDKWEIAEEDKAKLAIPGSRIQATGYLEGQPIHATLVVEEGNPAAPAVPT
VTVGGEAVTGLTSQKPMQYRTLAYGAKLPEVTASAKNAAVTVLQASAANGMRASIFIQPKDGGPLQTYA
IQFLEEAPKIAHLSLQVEKADSLKEDQTVKLSVRAHYQDGTQAVLPADKVTFSTSGEGEVAIRKGMLEL
HKPGAVTLNAEYEGAKDQVELTIQANTEKKIAQSIRPVNVVTDLHQEPSLPATVTVEYDKGFPKTHKVT
WQAIPKEKLDSYQTFEVLGKVEGIDLEARAKVSVEGIVSVEEVSVTTPIAEAPQLPESVRTYDSNGHVS
SAKVAWDAIRPEQYAKEGVFTVNGRLEGTQLT SP053 nucleotide (SEQ ID NO:85)
AGCTAAGGTTGCATGGGATGCGATTCGTCCAGAGCAATACGCTAAGGAAGGTGTCTTTACAGTTAATGG
TCGCTTAGAAGGTACGCAATTAACAACTAAACTTCATGTTCGCGATCTGCTCAAACTGAGCAAGGTGC
AAACATTTCTGACCAATGGACCGGTTCAGAATTGCCACTTGCCTTTGCTTCAGACTCAAATCCAAGCGA
CCCAGTTTCAAATGTTAATGACAAGCTCATTTCCTACAATAACCAACCAGCCAATCGTTGGACAAACTG
GAATCGTACTAATCCAGAAGCTTCAGTCGGTGTTCTGTTTGGAGATTCAGGTATCTTGAGCAAACGCTC
CGTTGATAATCTAAGTGTCGGATTCCATGAAGACCATGGTGTACCGAAGTCTTATGTGATTGA
GTATTATGTTGGTAAGACTGTCCCAACAGCTCCTAAAAACCCTAGTTTTGTTGGTAATGAGGACCATGT
CTTTAATGATTCTGCCAACTGGAAACCAGTTACTAATCTAAAAGCCCCTGCTCAACTCAAGGCTGGAGA
AATGAACCACTTTAGCTTTGATAAAGTTGAAACCTATGCTGTTGGTATTCGCATGGTTAAAGCAGATAA
CAAGCGTGGAACGTCTATCACAGAGGTACAAATCTTTGCGAAACAAGTTGCGGCAGCCAAGCAAGGACA
AACAAGAATCCAAGTTGACGGCAAAGACTTAGCAAACTTCAACCCTGATTTGACAGACTACTACCTTGA
GTCTGTAGATGGAAAAGTTCCGGCAGTCACAGCAAGTGTTAGCAACAATGGTCTCGCTACCGTCGTTCC
AAGCGTTGGTGAAGGTGAGCCAGTTCGTGTCATCGCGAAAGCTGAAAATGGCGACATCTTAGGAGAATA
CCGTCTGCACTTCACTAAGGATAAGAGCTTACTTTCTCATAAACCAGTTGCTGCGGTTAAACAAGCTCG
CTTGCTACAAGTAGGTCAAGCACTTGAATTGCCGACTAAGGTTCCAGTTTACTTCACAGGTAAAGACGG
CTACGAAAGAAAAGACCTGACAGTTGAATGGGAAGAAGTTCCAGCGGAAAATCTGACAAAAGCAGGTCA
ATTTACTGTTCGAGGCCGTGTCCTTGGTAGTAACCTTGTTGCTGAGATCACTGTACGAGTGACAGACAA
ACTTGGTGAGACTCTTTCAGATAACCCTAACTATGATGAAAACAGTAACCAGGCCTTTGCTTCAGCAAC
CAATGATATTGACAAAAACTCTCATGACCGCGTTGACTATCTCAATGACGGAGATCATTCACAAAATCG
TCGTTGGACAAACTGGTCACCAACACCATCTTCTAATCCAGAAGTATCAGCGGGTGTGATTTTCCGTGA
AAATGGTAAGATTGTAGAACGGACTGTTACACAAGGAAAAGTTCAGTTCTTTGCAGATAGTGGTACGGA
TGCACCATCTAAACTCGTTTTAGAACGCTATGTCGGTCCAGAGTTTGAAGTGCCAACCTACTATTCAAA
CTACCAAGCCTACGACGCAGACCATCCATTCAACAATCCAGAAAATTGGGAAGCTGTTCCTTATCGTGC
GGATAAAGACATTGCAGCTGGTGATGAAATCAACGTAACATTTAAAGCTATCAAAGCCAAAGCTATGAG
ATGGCGTATGGAGCGTAAAGCAGATAAGAGCGGTGTTGCGATGATTGAGATGACCTTCCTTGCACCAAG
TGAATTGCCTCAAGAAAGCACTCAATCAAAGATTCTTGTAGATGGAAAAGAACTTGCTGATTTCGCTGA
AAATCGTCAAGACTATCAAATTACCTATAAAGGTCAACGGCCAAAAGTCTCAGTTGAAGAAAACAATCA
AGTAGCTTCAACTGTGGTAGATAGTGGAGAAGATAGCTTTCCAGTACTTGTTCGCCTCGTTTCAGAAAG
TGGAAAACAAGTCAAGGAATACCGTATCCACTTGACTAAGGAAAAACCAGTTTCTGAGAAGACAGTTGC
TGCTGTACAAGAAGATCTTCCAAAAATCGAATTTGTTGAAAAAGATTTGGCATACAAGACAGTTGAGAA
AAAAGATTCAACACTGTATCTAGGTGAAACTCGTGTAGAACAAGAAGGAAAAGTTGGAAAAGAACGTAT
CTTTACAGCGATTAATCCTGATGGAAGTAAGGAAGAAAAACTCCGTGAAGTGGTAGAAGTTCCGACAGA
CCGCATCGTCTTGGTTGGAACCAAACCAGTAGCTCAAGAAGCTAAAAAACCACAAGTGTCAGAAAAAGC
AGATACAAAACCAATTGATTCAAGTGAAGCTAGTCAAACTAATAAAGCCCAG SP053 amino acid (SEQ ID NO:86)
AKVAWDAIRPEQYAKEGVFTVNGRLEGTQLTTKLHVRVSAQTEQGANISDQWTGSELPLAFASDSNPSD
PVSNVNDKLISYNNQPANRWTNWNRTNPEASVGVLFGDSGILSKRSVDNLSVGFHEDHGVGVPKSYVIE
YYVGKTVPTAPKNPSFVGNEDHVFNDSANWKPVTNLKAPAQLKAGEMNHFSFDKVETYAVRIRMVKADN
KRGTSITEVQIFAKQVAAAKQGQTRIQVDGKDLANFNPDLTDYYLESVDGKVPAVTASVSNNGLATVVP
SVREGEPVRVIAKAENGDILGEYRLHFTKDKSLLSHKPVAAVKQARLLQVGQALELPTKVPVYFTGKDG
YETKDLTVEWEEVPAENLTKAGQFTVRGRVLGSNLVAEITVRVTDKLGETLSDNPNYDENSNQAFASAT
NDIDKNSHDRVDYLNDGDHSENRRWTNWSPTPSSNPEVSAGVIFRENGKIVERTVTQGKVQFFADSGTD
APSKLVLERYVGPEFEVPTYYSNYQAYDADHPFNNPENWEAVPVRADKDIAAGDEINVTFKAIKAKAMR
WRMERKADKSGVAMIEMTFLAPSELPQESTQSKILVDGKELADFAENRQDYQITYKGQRPKVSVEENNQ
VASTVVDSGEDSFPVLVRLVSESGKQVKEYRIHLTKEKPVSEKTVAAVQEDLPKIEFVEKDLAYKTVEK
KDSTLYLGETRVEQEGKVGKERIFTAINPDGSKEEKLREVVEVPTDRIVLVGTKPVAQEAKKPQVSEKA
DTKPIDSSEASQTNKAQ SP054 nucleotide (SEQ ID NO:87)
CTATCACTATGTAAATAAAGAGATTATTTCACAAGAAGCTAAAGATTTAATTCAGACAGGAAAGCCTGA
CAGGGATGAAGTTGTATATGGTTTGGTGTATCAAAAAGATCAGTTGCCTCAAACAGGGACAGAA SP054 amino acid (SEQ ID NO:88)
YHYVNKEIISQEAKDLIQTGKPDRNEVVYGLVYQKDQLPQTGTE SP055 nucleotide (SEQ ID NO:89)
TGAGACTCCTCAATCAATAACAAATCAGGAGCAAGCTAGGACAGAAAACCAAGTAGTAGAGACAGAGGA
AGCTCCAAAAGAAGAAGCACCTAAAACAGAAGAAAGTCCAAAGGAAGAACCAAAATCGGAGGTAAAACC
TACTGACGACACCCTTCCTAAAGTAGAAGAGGGGAAAGAAGATTCAGCAGAACCAGCTCCAGTTGAAGA
AGTAGGTGGAGAAGTTGAGTCAAAACCAGAGGGAAAAAGTAGCAGTTAAGCCAGAAAGTCAACCATCAGA
CAAACCAGCTGAGGAATCAAAAGTTGAACAAGCAGGTGAACCACTCGCGCCAAGAGAAGACGAAAAGGC
ACCAGTCGAGCCAGAAAAGCAACCAGAAGCTCCTGAAGAAGAGAAGGCTGTAGAGGGAAACACCGAAACA
AGAAGAGTCAACTCCAGATACCAAGGCTGAAGAAACTGTAGAACCAAAAGAGGAGACTGTTAATCAATC
TATTGAACAACCAAAAGTTGAAACGCCTGCTGTAGAAAAACAAACAGAACCAACAGAGGAACCAAAAGT TABLE 1-continued

```
TGAACAAGCAGGTGAACCAGTCGCGCCAAGAGAAGACGAACAGGCACCAACGGCACCAGTTGAGCCAGA
AAAGCAACCAGAAGTTCCTGAAGAAGAGAAGGCTGTAGAGGAAACACCGAAACCAGAAGATAAAATAAA
GGGTATTGGTACTAAAGAACCAGTTGATAAAAGTGAGTTAAATAATCAAATGGATAAAGCTAGTTCAGT
TTCTCCTACTGATTAT

SP055 amino acid (SEQ ID NO:90)
ETPQSITNQEQARTENQVVETEEAPKEEAPKTEESPKEEPKSEVKPTDDTLPKVEEGKEDSAEPAPVEE
VGGEVESKPEEKVAVKPESQPSDKPAEESKVEQAGEPVAPREDEKAPVEPEKQPEAPEEEKAVEETPKQ
EESTPDTKAEETVEPKEETVNQSIEQPKVETPAVEKQTEPTEEPKVEQAGEPVAPREDEQAPTAPVEPE
KQPEVPEEEKAVEETPKPEDKIKGIGTKEPVDKSELNNQIDKASSVSPTDY SP056 nucleotide (SEQ ID NO:91)
GGATGCTCAAGAAACTGCGGGAGTTCACTATAAATATGTGGCAGATTCAGAGCTATCATCAGAAGAAAA
GAAGCAGCTTGTCTATGATATTCCGACATACGTGGAGAATGATGATGAAACTTATTATCTTGTTTATAA
GTTAAATTCTCAAAATCAACTGGCGGAATTGCCAAATACTGGAAGCAAGAATGAGAGGCAA SP056 amino acid (SEQ ID NO:92)
DAQETAGVHYKYVADSELSSEEKKQLVYDIPTYVENDDETYYLVYKLNSQNQLAELPNTGSKNERQ SP057 nucleotide (SEQ ID NO:93)
CGACAAAGGTGAGACTGAGGTTCAACCAGAGTCGCCAGATACTGTGGTAAGTGATAAAGGTGAACCAGA
GCAGGTAGCACCGCTTCCAGAATATAAGGGTAATATTGAGCAAGTAAAACCTGAAACTCCGGTTGAGAA
GACCAAAGAACAAGGTCCAGAAAAAACTGAAGAAGTTCCAGTAAAACCAACAGAAGAAACACCAGTAAA
TCCAAATGAAGGTACTACAGAAGGAACCTCAATTCAAGAAGCAGAAAATCCAGTTCAACCTGCAGAAGA
ATCAACAACGAATTCAGAGAAAGTATCACCAGATACATCTGACAAAAATACTGGGGAAGTGTCCAGTAA
TCCTAGTGATTCGACAACCTCAGTTGGAGAATCAAATAAACCAGAACATAATGACTCTAAAAATGAAAA
TTCAGAAAAAACTGTAGAAGAAGTTCCAGTAAATCCAAATGAAGGCACAGTAGAAGGTACCTCAAATCA
AGAAACAGAAAAACCAGTTCAACCTGCAGAAGAAACACAAACAAAACTCTGGGAAAATAGCTAACGAAAA
TACTGGGAAGTATCCAATAAACCTAGTGATTCAAAACCACCAGTTGAGAATCAAATCAACCAGAAGA
AAACGGAACTGCAACAAAACCAGAAATTCAGGTAATACAACATCAGAGAATGGACAAACAGAACCAGA
ACCATCAAACGGAAATTCAACTGAGGATGTTTCAACCGAATCAAACATATCCAATTCAAATGGAAACGA
AGAAATTAAACAAGAAAATGAACTAGACCCTGATAAAAAGGTAGAAGAACCAGAGAAAACACTTGAATT
AAGAAAT SP057 amino acid (SEQ ID NO:94)
DKGETEVQPESPDTVVSDKGEPEQVAPLPEYKGNIEQVKPETPVEKTKEQGPEKTEEVPVKPTEETPVN
PNEGTTEGTSIQEAENPVQPAEESTTNSEKVSPDTSSKNTGEVSSNPSDSTTSVGESNKPEHNDSKNEN
SEKTVEEVPVNPNEGTVEGTSNQETEKPVQPAEETQTNSGKIANENTGEVSNKPSDSKPPVEESNQPEK
NGTATKPENSGNTTSENGQTEPEPSNGNSTEDVSTESNTSNSNGNEEIKQENELDPDKKVEEPEKTLEL
RN SP058 nucleotide (SEQ ID NO:95)
AAATCAATTGGTAGCACAAGATCCAAAAGCACAAGATAGCACTAAACTGACTGCTGAAAAATCAACTGT
TAAAGCACCTGCTCAAAGAGTAGATGTAAAAGATATAACTCATTTAACAGATGAAGAAAAAGTTAAGGT
TGCTATTTTACAAGCAAATGGTTCAGCATTAGACGGAGCGACAATCAATGTAGCTGGAGATGGTACAGC
AACAATCACATTCCCAGATGGTTCAGTAGTGACGATTCTAGGAAAAGATACAGTTCAACAATCTGCGAA
AGGTGAATCTGTAACTCAAGAAGCTACACCAGAGTATAAGCTAGAAAATACACCAGGTGGAGATAAGGG
AGGCAATACTGGAAGCTCAGATGCTAATGCGAATGAAGGCGGTGGTAGCCAGGCGGGTGGATCAGCTCA
CACAGGTTCACAAAACTCAGCTCAATCACAAGCTTCTAAGCAATTAGCTACTGAAAAAGAATCAGCTAA
AAATGCCATTGAAAAAGCAGCCAAGGACAAGCAGGATGAAATCAAAGGCGCACCGCTTTCTGATAAAGA
AAAAGCAGAACTTTTAGCAAGAGTGGAAGCAGAAAAACAAGCAGCTCTCAAAGAGATTGAAAATGCGAA
AACTATGGAAGATGTGAAGGAAGCAGAAACGATTGGAGTGCAAGCCATTGCCATGGTTACAGTTCCTAA
GAGACCAGTGGCTCCTAAT SP058 amino acid (SEQ ID NO:96)
NQLVAQDPKAQDSTKLTAEKSTVKAPAQRVDVKDITHLTDEEKVKVAILQANGSALDGATINVAGDGTA
TITFPDGSVVTILGKDTVQQSAKGESVTQEATPEYKLENTPGGDKGGNTGSSDANANEGGGSQAGGSAH
TGSQNSAQSQASKQLATEKESAKNAIEKAAKDKQDEIKGAPLSDEKAELLARVEAEKQAALKEIENAK
TMEDVKEAETIGVQAIAMVTVPKRPVAPN SP059 nucleotide (SEQ ID NO:97)
CAAACAGTCAGCTTCAGGAACGATTGAGGTGATTTCACGAGAAAATGGCTCTGGGACACGGGGTGCCTT
CACAGAAATCACAGGGATTCTCAAAAAAGACGGTGATAAAAAAATTGACAACACTGCCAAAACAGCTGT
GATTCAAAATAGTACAGAAGGTGTTCTCTCAGCAGTTCAAGGGAATGCTAATGCTATCGGCTACATCTC
CTTGGGATCTTTAACGAAATCTGTCAAGGCTTTAGAGATTGATGGTGTCAAGGCTAGTCGAGACACAGT
TTTAGATGGTGAATACCCTCTTCAACGTCCCTTCAACATTGTTTGGTCTTCTAATCTTTCCAAGCTAGG
TCAAGATTTTATCAGCTTTATCCACTCCAAACAAGGTCAACAAGTGGTCACAGATAATAAATTTATTGA
AGCTAAAACCGAAACCACGGAATATACAAGCCAACACTTATCAGGCAAGTTGTCTGTTGTAGGTTCCAC
TTCAGTATCTTCTTTAATGGAAAAATTAGCAGAAGCTTATAAAAAAGAAAATCCAGAAGTTACGATTGA
TATTACCTCTAATGGGTCTTCAGCAGGTATTACCGCTGTTAAGGAGAAACCGCTGATATTGGTATGGT
TTCTAGGGAATTAACTCCTGAAGAAGGTAAGAGTCTCACCCATGATGCTATTGCTTTAGACGGTATTGC
TGTTGTGGTCAATAATGACAATAAGCCAAGGCAAGTCAGTATGGCTGAACTTGCAGACGTTTTTAGTGG
CAAATTAACCACCTGGGACAAGATTAAA SP059 amino acid (SEQ ID NO:98)
KQSASGTIEVISRENGSGTRGAFTEITGILKKDGDKKIDNTAKTAVIQNSTEGVLSAVQGNANAIGYIS
LGSLTKSVKALEIDGVKASRDTVLDGEYPLQRPFNIVWSSNLSKLGQDFISFIHSKQGQQVVTDNKFIE
AKTETTEYTSQHLSGKLSVVGSTSVSSLMEKLAEAYKKENPEVTIDITSNGSSAGITAVKEKTADIGMV
SRELTPEEGKSLTHDAIALDGIAVVVNNDNAASQVSMAELADVFSGKLTWDKIK
```

TABLE 1-continued

SP060 nucleotide (SEQ ID NO:99)
ATTCGATGATGCGGATGAAAAGATGACCCGTGATGAAATTGCCTATATGCTGACAAATAGTGAAGAAAC
ATTGGATGCTGATGAGATTGAGATGCTACAAGGTGTCTTTTCGCTCGATGAACTGATGGCACGAGAGGT
TATGGTTCCTCGAACGGATGCCTTTATGGTGGATATTCAGGATGATAGTCAAGCCATTATCCAAAGTAT
TTTAAAACAAAATTATTCTCGTATCCCGGTTTATGATGGGGATAAGGACAATGTAATTGGAATCATTCA
CACCAAGAGTCTCCTTAAGGCAGGCTTTGTGGACGGTTTTGACAATATTGTTTGGAAGAGAATTTTACA
AGATCCACTTTTTTGTACCTGAAACTATTTTTGTGGATGACTTGCTAAAAGAACTGCGAAATACCCAAG
ACAAATG SP060 amino acid (SEQ ID NO:100)
FDDADEKMTRDEIAYMLTNSEETLDADEIEMLQGVFSLDELMAREVMVPRTDAFMVDIQDDSQAIIQSI
LKQNYSRIPVYDGDKDNVIGIIHTKSLLKAGFVDGFDNIVWKRILQDPLFVPETIFVDDLLKELRNTQR
QM SP062 nucleotide (SEQ ID NO:101)
GGAGAGTCGATCAAAAGTAGATGAAGCTGTGTCTAAGTTTGAAAAGGACTCATCTTCTTCGTCAAGTTC
AGACTCTTCCACTAAACCGGAAGCTTCAGATACAGCGAAGCCAAACAAGCCGACAGAACCAGGAGAAAA
GGTAGCAGAAGCTAAGAAGAAGGTTGAAGAAGCTGAGAAAAAAGCCAAGGATCAAAAAGAAGAAGATCG
TCGTAACTACCCAACCATTACTTACAAAACGCTTGAACTTGAAATTGCTGAGTCCGATGTGGAAGTTAA
AAAAGCGGAGCTTGAACTAGTAAAAGTGAAAGCTAACGAACCTCGAGACGAGCAA SP062 amino acid (SEQ ID NO:102)
ESRSKVDEAVSKFEKDSSSSSSDSSTKPEASDTAKPNKPTEPGEKVAEAKKKVEEAEKKAKDQKEEDR
RNYPTITYKTLELEIAESDVEVEKKAELELVKVKANEPRDEQ SP063 nucleotide (SEQ ID NO:103)
ATGGACAACAGGAAACTGGGACGAGGTTATATCTGGTAAGATTGACAAGTACAAAGATCCAGATATTCC
AACAGTTGAATCAGAAGAAGTTACGTCAGACTCTAGTGATAAAGAAATAACGGTAAGGTATGACCGTTT
ATCAACACCAGAAAAACCAATCCCACAACCAAATCCAGAGCATCCAAGTGTTCCGACACCAAACCCAGA
ACTACCAAATCAAGAGACTCCAACACCAGATAAACCAACTCCAGAACCAGGTACTCCAAAAACTGAAAC
TCCAGTGAATCCAGACCCAGAAGTTCCGACTTATGAGACAGGTAAGAGAGAGGAATTGCCAAACACAGG
TACAGAAGCTAAT SP063 amino acid (SEQ ID NO:104)
WTTGNWDEVISGKIDKYKDPDIPTVESQEVTSDSSDKEITVRYDRLSTPEKPIPQPNPEHPSVPTPNPE
LPNQETPTPDKPTPEPGTPKTETPVNPDPEVPTYETGKREELPNTGTEAN SP064 nucleotide (SEQ ID NO:105)
CGATGGGCTCAATCCAACCCCAGGTCAAGTCTTACCTGAAGAGACATCGGGAACGAAAGAGGGTGACTT
ATCAGAAAAACCAGGAGACACCGTTCTCACTCAAGCGAAACCTGAGGGCGTTACTGGAAATACGAATTC
ACTTCCGACACCTACAGAAAGAACTGAAGTGAGCGAGGAAACAAGCCCTTCTAGTCTGGATACACTTTT
TGAAAAAGATGAAGAAGCTCAAAAAAATCCAGAGCTAACAGATGTCTTAAAAGAAACTGTAGATACAGC
TGATGTGGATGGGACACAAGCAAGTCCAGCAGAAACTACTCCTGAACAAGTAAAAGGTGGAGTGAAAGA
AAATACAAAAGACAGCATCGATGTTCCTGCTGCTTATCTTGAAAAGGCTGAAGGGAAAGGTCCTTTCAC
TGCCGGTGTAAACCAAGTAATTCCTTATGAACTATTCGCTGGTGATGGTATGTTAACTCGTCTATTACT
AAAAGCTTCGGATAATGCTCCTTGGTCTGACAATGGTACTGCTAAAAATCCTGCTTTACCTCCTCTTGA
AGGATTAACAAAAGGGAAATACTTCTATGAAGTAGACTTAAAGGGCAATACTGTTGGTAAACAAGGTCA
AGCTTTAATTGATCAACTTCGCGCTAATGGTACTCAAACTTATAAAGCTACTGTTAAAGTTTACGGAAA
TAAAGACGGTAAAGCTGACTTGACTAATCTAGTTGCTACTAAAAATGTAGACATCAACATCAATGGATT
AGTTGCTAAAGAAACAGTTCAAAAAGCCGTTGCAGACAACGTTAAAGACAGTATCGATGTTCCAGCAGC
CTACCTAGAAAAAGCCAAGGGTGAAGGTCCATTCACAGCAGGTGTCAACCATGTGATTCCATACGAACT
CTTCGCAGGTGATGGCATGTTGACTCGTCTCTTGCTCAAGGCATCTGACAAGGCACCATGGTCAGATAA
CGGCGACGCTAAAAACCCAGCCCTATCTCCACTAGGCGAAAACGTGAAGACCAAAGGTCAATACTTCTA
TCAANTAGCCTTGGACGGAAATGTAGCTGGCAAAGAAAAACAAGCGCTCATTGACCAGTTCCGAGCAAA
NGGTACTCAAACTTACAGCGCTACAGTCAATGTCTATGGTAACAAAGACGGTAAACCAGACTTGGACAA
CATCGTAGCAACTAAAAAAGTCACTATTAACATAAACGGTTTAATTTCTAAAGAAACAGTTCAAAAAGC
CGTTGCAGACAACGTTAAGACAGTATCGATGTTCCAGCAGCCTACCTAGAAAAAGCCAAGGGTGAAGG
TCCATTGACAGCAGGTGTCAACCATGTGATTCCATACGAACTCTTCGCAGGTGATGGTATGTTGACTCG
TCTCTTGCTCAAGGCATCTGACAAGGCACCATGGTCAGATAACGGNGACGCTAAAAACCCAGCNCTATC
TCCACTAGGTGAAAACGTGAAGACCAAAGGTCAATACTTCTATCAANTAGCCTTGGACGGAAATGTAGC
TGGCAAAGAAAAACAAGCGCTCATTGACCAGTTCCGAGCAAACGGTACTCAAACTTACAGCGCTACAGT
CAATGTCTATGGTAACAAAGACGGTAAACCAGACTTGGACAACATCGTAGCAACTAAAAAAGTCACTAT
TAAGATAAATGTTAAAGAAACATCAGACACAGCAAATGGTTCATTATCACCTTCTAACTCTGGTTCTGG
CGTGACTCCGATGAATCACAATCATGCTACAGGTACTACAGATAGCATGCCTGCTGACACCATGACAAG
TTCTACCAACACGATGGCAGGTGAAAACATGGCTGCTTCTGCTAACAAGATGTCTGATACGATGATGTC
AGAGGATAAAGCTATG SP064 amino acid (SEQ ID NO:106)
DGLNPTPGQVLPEETSGTKEGDLSEKPGDTVLTQAKPEGVTGNTNSLPTPTERTEVSEETSPSSLDTLF
EKDEEAQKNPELTDVLKETVDTADVDGTQASPAETTPEQVKGGVKENTKDSIDVPAAYLEKAEGKGPFT
AGVNQVIPYELFAGDGMLTRLLLKASDNAPWSDNGTAKNPALPPLEGLTKGKYFYEVDLNGNTVGKQGQ
ALIDQLRANGTQTYKATVKVYGNKDGKADLTNLVATKNVDININGLVAKETVQKAVADNVKDSIDVPAA
YLEKAKGEGPFTAGVNHVIPYELFAGDGMLTRLLLKASDKAPWSDNGTAKNPALSPLGENVKTKGQYFY
QXALDGNVAGKEKQALIDQFRAXGTQTYSATVNVYGNKDGKPDLDNIVATKKVTININGLISKETVQKA
VADNVXDSIDVPAAYLEKAKGEGPFTAGVNHVIPYELFAGDGMLTRLLLKASDKAPWSDNGDAKNPALS
PLGENVKTKGQYFYQXALDGNVAGKEKQALIDQFRANGTQTYSATVNVYGNKDGKPDLDNIVATKKVTI
KINVKETSDTANGSLSPSNSGSGVTPMNHNHATGTTDSMPADTMTSSTNTMAGENMAASANKMSDTMMS
EDKAM TABLE 1-continued SP065 nucleotide (SEQ ID NO:107)
TTCCAATCAAAAACAGGCAGATGGTAAACTCAATATCGTGACAACCTTTTACCCTGTCTATGArTTTAC
CAAGCAAGTCGCAGGAGATACGGCTAATGTAGAACTCCTAATCGGTGCTGGGACAGAACCTCATGAATA
CGAACCATCTGCCAAGGCAGTTGCCAAAATCCAAGATGCAGATACCTTCGTTTATGAAAATGAAAACAT
GGAAACATGGGTACCTAAATTGCTAGATACCTTGGATAAGAAAAAAGTGAAAACCATCAAGGCGACAGG
CGATATGTTGCTCTTGCCAGGTGGCGAGGAAGAAGAGGGAGACCATGACCATGGAGAAGAAGGTCATCA
CCATGAGTTTGACCCCCATGTTTGGTTATCACCAGTTCGTGCCATtAAACTAGTAGAGCACCATCCGCG
ACACTTGTCAGCAGATTATCCTGATAAAAAAGAGACCTTTGAGAAGAATGCAGCTGCCTATATCGAAAA
ATTGCAAGCCTTGGATAAGGCTTACGCAGAAGGTTTGTCTCAAGCAAAACAAAAGAGCTTTGTGACTCA
ACACGCAgCCTTTAACTaTCTTGCCTTGGACTATGGGACTC SP065 amino acid (SEQ ID NO:108)
SNQKQADGKLNIVTTFYPVYEFTKQVAGDTANVELLIGAGTEPHEYEPSAKAVAKIQDADTFVYENENM
ETWVPKLLDTLDKKKVKTIKATGDMLLLPGGEEEEGDHDHGEEGHHHEFDPHVWLSPVRAIKLVEHHPR
HLSADYPDKKETFEKNAAAYIEKLQALDKAYAEGLSQAKQKSFVTQHAAFNYLALDYGT SP067 nucleotide (SEQ ID NO:109)
TATCACAGGATCGAACGGTAAGACAACCACAACGACTATGATTGGGGAAGTTTTGACTGCTGCTGGCCA
ACATGGTCTTTTATCAGGGAATATCGGCTATCCAGCTAGTCAGGTTGCTCAAATAGCATCAGATAAGGA
CACGCTTGTTATGGAACTTTCTTCTTTCCAACTCATGGGTGTTCAAGAATTCCATCCAGAGATTGCGGT
TATTACCAACCTCATGCCAACTCATATCGACTACCATGGGTCATTTTCGGAATATGTAGCAGCCAAGTG
GAATATCCAGAACAAGATGACAGCAGCTGATTTCCTTGTCTTGAACTTTAATCAAGACTTGGCAAAAGA
CTTGACTTCCAAGACAGAAGCCACTGTTGTACCATTTTCAACACTTGAAAAGGTTGATGGAGCTTATCT
GGAAGATGGTCAACTCTACTTCCGTGGTGAAGTAGTCATGGCAGCGAATGAAATCGGTGTTCCAGGTAG
CCACAATGTGGAAAATGCCCTTGCGACTATTGCTGTAGCCAAGCTTCGTGATGTGGACAATCAAACCAT
CAAGGAAACTCTTTCAGCCTTCGGTGGTGTCAAACACCGTCTCCAGTTTGTGGATGACATCAAGGGTGT
TAAATTCTATAACGACAGTAAATCAACTAATATCTTGGCTACTCAAAAAGCCTTGTCAGGATTTGACAA
CAGCAAGGTCGTCTTGATTGCAGGTGGTTTGGACCGTGGCAATGAGTTTGACGAATTGGTGCCAGACAT
TACTGGACTCAAGAAGATGGTCATCCTGGGTCAATCTGCAGAACGTGTCAAACGGGCAGCAGACAAGGC
TGGTGTCGCTTATGTGGAGGCGACAGATATTGCAGATGCGACCCGCAAGGCCTATGAGCTTGCGACTCA
AGGAGATGTGGTTCTTCTTAGTCCTGCCAATGCTAGCTGGGATATGTATGCTAACTTTGAAGTACGTGG
CGACCTCTTTATCGACACAGTAGCGGAGTTAAAAGAA SP067 amino acid (SEQ ID NO:110)
GITGSNGKTTTTTMIGEVLTAAGQHGLLSGNIGYPASQVAQIASDKDTLVMELSSFQLMGVQEFHPEIA
VITNLMPTHIDYHGSFSEYVAAKWNIQNKMTAADFLVLNFNQDLAKDLTSKTEATVVPFSTLEKVDGAY
LEDGQLYFRGEVVMAANEIGVPGSHNVENALATIAVAKLRDVDNQTIKETLSAFGGVKHRLQFVDDIKG
VKFYNDSKSTNILATQKALSGFDNSKVVLIAGGLDRGNEFDELVPDITGLKKMVILGQSAERVARAADK
AGVAYVEATDIADATRKAYELATQGDVVLLSPANASWDMYANFEVRGDLFIDTVAELKE SP068 nucleotide (SEQ ID NO:111)
AAGTTCATCGAAGATGGTTGGGAAGTCCACTATATCGGGGACAAGTGTGGTATCGAACACCAAGAAATC
CTTAAGTCAGGTTTGGATGTCCACCTTCCATTCTATTGCGACTGGAAAATTGCGTCGCTATTTCTCTTGG
CAAAATATGCTGGACGTCTTCAAAGTTGGTTGGGGAATTGTCCAATCGCTCTTTATCATGTTGCGACTG
CGTCCACAGACCCCTTTTTTCAAAGGGGGGCTTTGTCTCAGTACCGCCTGTTATCGCTGCGCGTGTGTCA
GGAGTGCCTGTCTTTATTCACGAATCTGACCTGTCTATGGGCTTGGCCAATAAAATCGCCTATAAATTT
GCGACTAAGATGTATTCAACCTTTGAACAAGCTTCGAGTTTGGCTAAGGTTGAGCATGTGGGAGCGG SP068 amino acid (SEQ ID NO:112)
SSSKMVGKSTISGTSVVSNTKKSLSQVWMSPSILLRLENCVAISLGKICWTSSKLVGELSNRSLSCCDC
VHRPFFQRGALSQYRLLSLRVCQECLSLFTNLTCLWAWPIKSPINLRLRCIQPLNKLRVWLRLSMWER SP069 nucleotide (SEQ ID NO:113)
ATCGCTAGCTAGTGAAATGCAAGAAAGTACACGTAAATTCAAGGTTACTGCTGACCTAACAGATGCCGG
TGTTGGAACGATTGAAGTTCCTTTGAGCATTGAAGATTTACCCAATGGGCTGACCGCTGTGGCGACTCC
GCAAAAAATTACAGTCAAGATTGGTAAGAAGGCTCAGAAGGATAAGGTAAAGATTGTACCAGAGATTGA
CCCTAGTCAAATTGATAGTCGGGTACAAATTGAAAATGTCATGGTGCAGATAAAGAAGTGTCTATTAC
GAGTGACCAAGAGACATTGGATAGAATTGATAAGATTATCGCTGTTTTGCCAACTAGCGAACGTATAAC
AGGTAATTACAGTGGTTCAGTACCTTTGCAGGCAATCGACCGCAATGGTGTTGTCTTACCGGCAGTTAT
CACTCCCTTTGATACAATAATGAAGGTGACTACAAAACCAGTAGCACCAAGTTCAAGCACATCAAATTC
AAGTACAAGCAGTTCATCGGAGACATCTTCGTCAACGAAAGCAACTAGTTCAAAAACGAAT SP069 amino acid (SEQ ID NO:114)
SLASEMQESTRKFKVTADLTDAGVGTIEVPLSIEDLPNGLTAVATPQKITVKIGKKAQKDKVKIVPEID
PSQIDSRVQIENVMVSDKEVSITSDQETLDRIDKIIAVLPTSERITGNYSGSVPLQAIDRNGVVLPAVI
TPFDTIMKVTTKPVAPSSSTSNSSTSSSSETSSSTKATSSKTN SP070 nucleotide (SEQ ID NO:115)
GCACCAGATGGGGCACAAGGTTCAGGGATCAGATGATTGAAAAGTACTACTTTACCCAACGCGGTCTTGA
GCAGGCAGGAATTACCATTCTTCCTTTTGATGAAAAAAATCTAGACGGTGATATGGAAATTATCGCTGG
AAATGCCTTTCGTCCAGATAACAACGTCGAAATTGCCTATGCGGACCAAAATGGTATCAGCTACAAACG
TTACCATGAGTTTCTAGGTAGCTTTATGCGTGACTTTGTTAGCATGGGAGTAGCAGGAGCACATGGAAA
AACTTCAACGACAGGTATGTTGTCTCATGTCTTGTCTCACATTACAGATACCAGCTTCTTGATTGGAA
TGGGACAGGTCGTGGTTCGGCCAATGCCAAATATTTTGTCTTTGAATCTGACGAATATGAGCGTCACTT
CATGCCTTACCACCCAGAATACTCTATTATCACCAACATTGACTTTGACCATCCAGATTATTTCACAAG
TCTCGAGGATGTTTTTAATGCCTTTAACGACTATGCCAAACAAATCACCAAGGGTCTTTTTGTCTATGG
TGAAGATGCTGAATTGCGTAAGATTACGTCTGATGCACCAATTTATTATTATGGTTTTGAAGCTGAAGG
CAATGACTTTGTAGCTAGTGATCTTCTTCGTTCAATAACTGGTTCAACCTTCACCGTTCATTTCCGTGG TABLE 1-continued

```
ACAAAACTTGGGGCAATTCCACATTCCAACCTTTGGTCGTCACAATATCATGAATGCGACAGCCGTTAT
TGGTCTTCTTTACACAGCAGGATTTGATTTGAACTTGGTGCGTGAGCACTTGAAAACATTTGCCGGTGT
TAAACGTCGTTTCACTGAGAAAATTGTCAATGATACAGTGATTATCGATGACTTTGCCCACCATCCAAC
AGAAATTATTGCGACCTTGGATGCGGCTCGTCAGAAATACCCAAGCAAGGAAATTGTAGCAGTCTTTCA
ACCGCATACCTTTACAAGAACCATTGCCTTGTTGGACGACTTTGCCCATGCTTTAAACCAAGCAGATGC
TGTTTATCTAGCGCAAATTTATGGCTCGGCTCGTGAAGTAGATCATGGTGACGTTAAGGTAGAAGACCT
AGCCAACAAAATCAACAAAAAACACCAAGTGATTACTGTTGAAAATGTTTCTCCACTCCTAGACCATGA
CAATGCTGTTTACGTCTTTATGGGAGCAGGAGACATCCAAACCTATGAATACTCATTTGAGCGTCTCTT
GTCTAACTTGACAAGCAATGTTCAA
```

SP070 amino acid (SEQ ID NO:116)
```
HQMGHKVQGSDVEKYYFTQRGLEQAGITILPFDEKNLDGDMEIIAGNAFRPDNNVEIAYADQNGISYKR
YHEFLGSFMRDFVSMGVAGAHGKTSTTGMLSHVLSHITDTSFLIGDGTGRGSANAKYFVFESDEYERHF
MPYHPEYSIITNIDFDHPDYFTSLEDVFNAFNDYAKQITKGLFVYGEDAELRKITSDAPIYYYGFEAEG
NDFVASDLLRSITGSTFTVHFRGQNLGQFHIPTFGRHNIMNATAVIGLLYTAGFDLNLVREHLKTFAGV
KRRFTEKIVNDTVIIDDFAHHPTEIIATLDAARQKYPSKEIVAVFQPHTFTRTIALLDDFAHALNQADA
VYLAQIYGSAREVDHGDVKVEDLANKINKKHQVITVENVSPLLDHDNAVYVFMGAGDIQTYEYSFERLL
SNLTSNVQ
```

SP071 nucleotide (SEQ ID NO:117)
```
TTTTAACCCAACTGTTGGTACTTTCCTTTTTACTGCAGGATTGAGCTTGTTAGTTTTATTGGTTTCTAA
AAGGGAAAATGGAAAGAAACGACTTGTTCATTTTCTGCTGTTGACTAGCATGGGAGTTCAATTGTTGCC
GGCCAGTGCTTTTGGGTTGACCAGCCAGATTTTATCTGCCTATAATAGTCAGCTTTCTATCGGAGTCGG
GGAACATTTACCAGAGCCTCTGAAAATCGAAGGTTATCAATATATTGGTTATATCAAAACTAAGAAACA
GGATAATACAGAGCTTTCAAGGACAGTTGATGGGAAATACTCTGCTCAAAGAGATAGTCAACCAAACTC
TACAAAAACATCAGATGTAGTTCATTCAGCTGATTTAGAATGGAACCAAGGACAGGGGAAGGTTAGTTT
ACAAGGTGAAGCATCAGGGGATGATGGACTTTCAGAAAAATCTTCTATAGCAGCAGACAATCTATCTTC
TAATGATTCATTCGCAAGTCAAGTTGAGCAGAATCCGGATCACAAAGGAGAATCTGTAGTTCGACCAAC
AGTGCCAGAACAAGGAAATCCTGTGTCTGCTACAACGGTGCAAGGTGCGGAAGGAGGAAGTATTGGCGC
GACAAATGATCGACCAGAGTATAAACTTCCATTGGAAACCAAAGGCACGCAAGAACCCGGTCATGAGGG
TGAAGCCGCAGTCCGTGAAGACTTACCAGTCTACACTAAGCCACTAGAAACCAAAGGTACACAAGGACC
CGGACATGAAGGTGAAGCTGCAGTTCGCGAGGAAGAACCAGCTTACACAGAACCGTTAGCAACGAAAGG
CACGCAAGAGCCAGGTCATGAGGGCAAAGCTACAGTCCGCGAAGAGACTCTAGAGTACACGGAACCGGT
AGCGACAAAAGGCACACAAGAACCCGAACATGAGGGCGAaCGGsCAGTAGAAGAAGAACTTCCGGCTTT
AGAGGTCACTACACGAAATAGAACGGAAATCCAGAATATTCCTTATACAACAGAAGAAATTCAGGATCC
AACACTTCTGAAAAATCGTCGTAAGATTGAACGACAAGGGCAAGCAGGGACACGTACAATTCAATATGA
AGACTACATCGTAAATGGTAATGTCGTAGAAACTAAAGAAGTGTCACGAACTGAAGTAGCTCCGGTCAA
CGAAGTCGTTAAAGTAGGAACACTTGTGAAAGTTAAACCTACAGTGAAATTACAAACTTAACAAAAGT
TGAGAACAAAAATCTATAACTGTAAGTTATAACTTAATAGACACTACCTCAGCATATGTTTCTGCAAA
AACGCAAGTTTTCCATGGAGACAAGCTAGTTAAAGAGGTGGATATAGAAAATCCTGCCAAAGAGCAAGT
AATATCAGGTTTAGATTACTACACACCGTATACAGTTAAAACACCTAACTTATAATTTGGGTGAAAA
TAATGAGGAAAATACTGAAACATCAACTCAAGATTTGCAATTAGAGTATAAGAAAATAGAGATTAAAGA
TATTGATTCAGTAGAATTATACGGTAAAGAAAATGATCGTTATCGTAGATATTTAAGTCTAAGTGAAGC
GCCGACTGATACGGCTAAATACTTTGTAAAAGTGAAATCAGATCGCTTCAAAGAAATGTACCTACCTGT
AAAATCTATTACAGAAAATACGGATGGAACGTATAAAGTGCGGTAGCCGTTGATCAACTTGTCGAAGA
AGGTACAGACGGTTACAAAGATGATTACACATTTACTGTAGCTAAATCTAAAGCAGAGCAACCAGGAGT
TTACACATCCTTTAAACAGCTGGTAACAGCCATGCAAAGCAATCTGTCTGGTGTCTATACATTGGCTTC
AGATATGACCGCAGATGAGGTGAGCTTAGGCGATAAGCAGACAAGTTATCTCACAGGTGCATTTACAGG
GAGCTTGATCGGTTCTGATGGAACAAAATCGTATGCCATTTATGATTTGAAGAAACCATTATTTGATAC
ATTAAATGGTGCTACAGTTAGAGATTTGGATATTAAAACTGTTTCTGCTGATAGTAAAGAAAATGTCGC
AGCGCTGGCGAAGGCAGCGAATAGCGCGAATATTAATAATGTTGCAGTAGAAGGAAAAATCTCAGGTGC
GAAATCTGTTGCGGGATTAGTAGCGAGCGCAACAAATACAGTGATAGAAAACAGCTCGTTTACAGGGAA
ACTTATCGGAAATCACCAGGACAGTAATAAAAATGATACTGGAGGAATAGTAGGTAATATAACAGGAAA
TAGTTCGAGAGTTAATAAAGTTAGGGTAGATGCCTTAATCTCTACTAATGCACGCAATAATAACCAAAC
AGCTGGAGGGATAGTAGGTAGATTAGAAAATGGTGCATTGATATCTAATTCGGTTGCTACTGGAGAAAT
ACGAAATGGTCAAGGATATTCTAGAGTCGGAGGAATAGTAGGATCTACGTGGCAAAACGGTCGAGTAAA
TAATGTTGTGAGTAACGTAGATGTTGGAGATGGTTATGTTATCACCGGTGATCAATACGCAGCAGCAGA
TGTGAAAAATGCAAGTACATCAGTTGATAATAGAAAAGCAGACAGATTCGCTACAAAATTATCAAAAGA
CCAAATAGACGCGAAAGTTGCTGATTATGGAATCACAGTAACTCTTGATGATACTGGGCAAGATTTAAA
ACGTAATCTAAGAGAAGTTGATTATACAAGACTAAATAAAGCAGAAGCTGAAAGAAAAGTAGCTTATAG
CAACATAGAAAAACTGATGCCATTCTACAATAAAGACCTAGTAGTTCACTATGGTAACAAAGTAGCGAC
AACAGATATAAACTTTACACTACAGAATTGTTAGATGTTGTGCCGATGAAAGATGATGAAGTAGTAACGGA
TATTAATAATAAGAAAAATTCAATAAATAAAGTTATGTTACATTTCAAAGATAATACAGTAGAATACCT
AGATGTAACATTCAAAGAAAACTTCATAAACAGTCAAGTAATCGAATACAATGTTACAGGAAAAGAATA
TATATTCACACCAGAAGCATTTGTTTCAGACTATACAGCGATAACGAATAACGTACTAAGCGACTTGCA
AAATGTAACACTTAAC
```

SP071 amino acid (SEQ ID NO:118)
```
FNPTVGTFLFTAGLSLLVLLVSKRENGKKRLVHFLLLTSMGVQLLPASAFGLTSQILSAYNSQLSIGVG
EHLPEPLKIEGYQYIGYIKTKKQDNTELSRTVDGKYSAQRDSQPNSTKTSDVVHSADLEWNQGQKVSL
QGEASGDDGLSEKSSIAADNLSSNDSFASQVEQNPDHKGESVVRPTVPEQGNPVSATTVQSAEEEVLAT
TNDRPEYKLPLETKGTQEPGHEGEAAVREDLPVYTKPLETKGTQGPGHEGEAAVREEEPAYTEPLATKG
TQEPGHEGKATVREETLEYTEPVATKGTQEPEHEGERXVEEELPALEVTTRNRTEIQNIPYTTEEIQDP
TLLKNRRKIERQGQAGTRTIQYEDYIVNGNVVETKEVSRTEVAPVNEVVKVGTLVKVKPTVEITNLTKV
ENKKSITVSYNLIDTTSAYVSAKTQVFHGDKLVKEVDIENPAKEQVISGLDYYTPYTVKTHLTYNLGEN
NEENTETSTQDFQLEYKKIEIKDIDSVELYGKENDRYRRYLSLSEAPTDTAKYFVKVKSDRFKEMYLPV
KSITENTDGTYKVTVAVDQLVEEGTDGYKDDYTFTVAKSKAEQPGVYTSFKQLVTAMQSNLSGVYTLAS
DMTADEVSLGDKQTSYLTGAFTGSLIGSDGTKSYAIYDLKKPLFDTLNGATVRDLDIKTVSADSKENVA
ALAKAANSANINNVAVEGKISGAKSVAGLVASATNTVIENSSFTGKLIANHQDSNKNDTGGIVGNITGN
```

TABLE 1-continued

SSRVNKVRVDALISTNARNNNQTAGGIVGRLENGALISNSVATGEIRNGQGYSRVGGIVGSTWQNGRVN
NVVSNVDVGDGYVITGDQYAAADVKNASTSVDNRKADRFATKLSKDQIDAKVADYGITVTLDDTGQDLK
RNLREVDYTRLNKAEAERKVAYSNIEKLMPFYNKDLVVHYGNKVATTDKLYTTELLDVVPMKDDEVVTD
INNKKNSINKVMLHFKDNTVEYLDVTFKENFINSQVIEYNVTGKEYIFTPEAFVSDYTAITNNVLSDLQ
NVTLN

SP072 nucleotide (SEQ ID NO:119)
TTTTAACCCAACTGTTGGTACTTTCCTTTTTACTGCAGGATTGAGCTTGTTAGTTTTATTGGTTTCTAA
AAGGGAAAATGGAAAGAAACGACTTGTTCATTTTCTGCTGTTGACTAGCATGGGAGTTCAATTGTTGCC
GGCCAGTGCTTTTGGGTTGACCAGCCAGATTTTATCTGCCTATAATAGTCAGCTTTCTATCGGAGTCGG
GGAACATTTACCAGAGCCTCTGAAAATCGAAGGTTATCAATATATTGGTTATATCAAAACTAAGAAACA
GGATAATACAGAGCTTTCAAGGACAGTTGATGGGAAATACTCTGCTCAAAGAGATAGTCAACCAAACTC
TACAAAAACATCAGATGTAGTTCATTCAGCTGATTTAGAATGGAACCAAGGACAGGGGAAGGTTAGTTT
ACAAGGTGAAGCATCAGGGGATGATGGACTTTCAGAAAAATCTTCTATAGCAGCAGACAATCTATCTTC
TAATGATTCATTCGCAAGTCAAGTTGAGCAGAATCCGGATCACAAAGGAGAATCTGTAGTTCGACCAAC
AGTGCCAGAACAAGGAAATCCTGTGTCTGCTACAACGGTGCAGAGTGCGGAAGAGGAAGTATTGGCGAC
GACAAATGATCGACCAGAGTATAAACTTCCATTGGAAACCAAAGGCACGCAAGAACCCGGTCATGAGGG
TGAAGCCGCAGTCCGTGAAGACTTACCAGTCTACACTAAGCCACTAGAAACCAAAGGTACACAAGGACC
CGGACATGAAGGTGAAGCTGCAGTTCGCGAGGAAGAACCAGCTTACACAGAACCGTTAGCAACGAAAGG
CACGCAAGAGCCAGGTCATGAGGGCAAAGCTACAGTCCGCGAAGAGACTCTAGAGTACACGGAACCGGT
AGCGACAAAAGGCACACAAGAACCCGAACATGAGGGCGAaCGGsCAGTAGAAGAAGAACTTCCGGCTTT
AGAGGTCACTACACGAAATAGAACGGAAATCCAGAATATTCCTTATACAACAGAAGAAATTCAGGATCC
AACACTTCTGAAAAATCGTCGTAAGATTGAACGACAAGGGCAAGCAGGGACACGTACAATTCAATATGA
AGACTACATCGTAAATGGTAATGTCGTAGAAACTAAAGAAGTGTCACGAACTGAAGTAGCTCCGGTCAA
CGAAGTCGTTAAAGTAGGAACACTTGTGAAAGTTAAACCTACAGTAGAAATTACAAACTTAACAAAAGT
TGAGAACAAAAAATCTATAACTGTAAGTTATAACTTAATAGACACTACCTCAGCATATGTTTCTGCAAA
AACGCAAGTTTTCCATGGAGACAAGCTAGTTAAAGAGGTGGATATAGAAAATCCTGCCAAAGAGCAAGT
AATATCAGGTTTAGATTACTACACACCGTATACAGTTAAAACACACCTAACTTATAATTTGGGTGAAAA
TAATGAGGAAAATACTGAAACATCAACTCAAGATTTCCAATTAGAGTATAAGAAAATAGAGATTAAAGA
TATTGATTCAGTAGAATTATACGGTAAAGAAAATGATCGTTATCGTAGA SP072 amino acid (SEQ ID NO:120)
FNPTVGTFLFTAGLSLLVLLVSKRENGKKRLVHFLLLTSMGVQLLPASAFGLTSQILSAYNSQLSIGVG
EHLPEPLKIEGYQYIGYIKTKKQDNTELSRTVDGKYSAQRDSQPNSTKTSDVVHSADLEWNQGQGKVSL
QGEASGDDGLSEKSSIAADNLSSNDSFASQVEQNPDHKGESVVRPTVPEQGNPVSATTVQSAEEEVLAT
TNDRPEYKLPLETKGTQEPGHEGEAAVREDLPVYTKPLETKGTQGPGHEGEAAVREEEPAYTEPLATKG
TQEPGHEGKATVREETLEYTEPVATKGTQEPEHEGERXVEEELPALEVTTRNRTEIQNIPYTTEEIQDP
TLLKNRRKIERQGQAGTRTIQYEDYIVNGNVVETKEVSRTEVAPVNEVVKVGTLVKVKPTVEITNLTKV
ENKKSITVSYNLIDTTSAYVSAKTQVFHGDKLVKEVDIENPAKEQVISGLDYYTPYTVKTHLTYNLGEN
NEENTETSTQDFQLEYKKIEIKDIDSVELYGKENDRYRR SP073 nucleotide (SEQ ID NO:121)
TCGTAGATATTTAAGTCTAAGTGAAGCGCCGACTGATACGGCTAAATACTTTGTAAAAGTGAAATCAGA
TCGCTTCAAAGAAATGTACCTACCTGTAAAATCTATTACAGAAAATACGGATGGAACGTATAAAGTGAC
GGTAGCCGTTGATCAACTTGTCGAAGAAGGTACAGACGGTTACAAAGATGATTACACATTTACTGTAGC
TAAATCTAAAGCAGAGCAACCAGGAGTTTACACATCCTTTAAACAGCTGGTAACAGCCATGCAAAGCAA
TCTGTCTGGTGTCTATACAATTGGCTTCAGATATGACCGCAGATGAGGTGAGCTTAGGCGATAAGCAGAC
AAGTTATCTCACAGGTGCATTTACAGGGAGCTTGATCGGTTCTGATGGAACAAAATCGTATGCCATTTA
TGATTTGAAGAAACCATTATTTGATACATTAAATGGTGCTACAGTTAGAGATTTGGATATTAAAACTGT
TTGTGCTGATAGTAAAGAAAATGTCGCAGCGCTGGCGAAGGCAGCGAATAGCGCGAATATTAATAATGT
TGCAGTAGAAGGAAAAATCTCAGGTGCGAAATCTGTTGCGGGATTAGTAGCGAGCGCAACAAATACAGT
GATAGAAAACAGCTCGTTTACAGGGAAACTTATCGCAAATCACCAGGACAGTAATAAAAATGATACTGG
AGGAATAGTAGGTAATATAACAGGAAATAGTTCGAGAGTTAATAAAGTTAGGGTAGATGCCTTAATCTC
TACTAATGCACGCAATAATAACCAAACAGCTGGAGGGATAGTAGGTAGATTAGAAAATGGTGCATTGAT
ATCTAATTCGGTTGCTACTGGAGAAATACGAAATGGTCAAGGATATTCTAGAGTCGGAGGAATAGTAGG
ATCTACGTGGCAAAACGGTCGAGTAAATAATGTTGTGAGTAACGTAGATGTTGGAGATGGTTATGTTAT
CACCGGTGATCAATACGCAGCAGCAGATGTGAAAAATGCAAGTACATCAGTTGATAATAGAAAAGCAGA
CAGATTCGCTACAAAATTATCAAAAGACCAAATAGACGCGAAAGTTGCTGATTATGGAATCACAGTAAC
TCTTGATGATACTGGGCAAGATTTAAAACGTAATCTAAGAGAAGTTGATTATACAAGACTAAATAAAGC
AGAAGCTGAAAGAAAAGTAGCTTATAGCAACATAGAAAAACTGATGCCATTCTACAATAAAGACCTAGT
AGTTCACTATGGTAACAAAGTAGCGACAACAGATAAACTTTACACTACAGAATTGTTAGATGTTGTGCC
GATGAAAGATGATGAAGTAGTAACGGATATTAATAATAAGAAAAATTCAATAAATAAAGTTATGTTACA
TTTCAAAGATAATACAGTAGAATACCTAGATGTAACATTCAAAGAAAACTTCATAAACAGTCAAGTAAT
CGAATACAATGTTACAGGAAAAGAATATATATTCACACCAGAAGCATTTGTTTCAGACTATACAGCGAT
AACGAATAACGTACTAAGCGACTTGCAAAATGTAACACTTAAC SP073 amino acid (SEQ ID NO:122)
RRYLSLSEAPTDTAKYFVKVKSDRFKEMYLPVKSITENTDGTYKVTVAVDQLVEEGTDGYKDDYTFTVA
KSKAEQPGVYTSFKQLVTAMQSNLSGVYTLASDMTADEVSLGDKQTSYLTGAFTGSLIGSDGTKSYAIY
DLKKPLFDTLNGATVRDLDIKTVSADSKENVAALAKAANSANINNVAVEGKISGAKSVAGLVASATNTV
IENSSFTGKLIANHQDSNKNDTGGIVGNITGNSSRVNKVRVDALISTNARNNNQTAGGIVGRLENGALI
SNSVATGEIRNGQGYSRVGGIVGSTWQNGRVNNVVSNVDVGDGYVITGDQYAAADVKNASTSVDNRKAD
RFATKLSKDQIDAKVADYGITVTLDDTGQDLKRNLREVDYTRLNKAEAERKVAYSNIEKLMPFYNKDLV
VHYGNKVATTDKLYTTELLDVVPMKDDEVVTDINNKKNSINKVMLHFKDNTVEYLDVTFKENFINSQVI
EYNVTGKEYIFTPEAFVSDYTAITNNVLSDLQNVTLN SP074 nucleotide (SEQ ID NO:123)
CTTTGGTTTTGAAGGAAGTAAGCGTGGACAATTTGCTGTAGAAGGAATCAATCAACTTCGTGAGCATGT
AGACACTCTATTGATTATCTCAAACAACAATTTGCTTGAAATTGTTGATAAGAAAACACCGCTTTTGGA TABLE 1-continued

```
GGCTCTTAGCGAAGCGGATAACGTTCTTCGTCAAGGTGTTCAAGGGATTACCGATTTGATTACCAATCC
AGGATTGATTAACCTTGACTTTGCCGATGTGAAAACGGTAATGGCAAACAAAGGGAATGCTCTTATGGG
TATTGGTATCGGTAGTGGAGAAGAACGTGTGGTAGAAGCGGCACGTAAGGCAATCTATTCACCACTTCT
TGAAACAACTATTGACGGTGCTGAGGATGTTATCGTCAACGTTACTGGTGGTCTTGACTTAACCTTGAT
TGAGGCAGAAGAGGCTTCACAAATTGTGAACCAGGCAGCAGGTCAAGGAGTGAACATCTGGCTCGGTAC
TACAATTGATGAAAGTATGCGTGATGAAATTCGTGTAACAGTTGTTGCAACGGGTGTTCGTCAAGACCG
CGTAGAAAAGGTTGTGGCTCCACAAGCTAGATCTGCTACTAACTACCGTGAGACAGTGAAACCAGCTCA
TTCACATGGCTTTGATCGTCATTTTGATATGGCAGAAACAGTTGAATTGCCAAAACAAAATCCACGTCG
TTTGGAACCAACTCAGGCATCTGCTTTTGGTGATTGGGATCTTCGCCGTGAATCGATTGTTCGTACAAC
AGATTCAGTCGTTTCTCCAGTCGAGCGCTTTGAAGCCCCAATTTCACAAGATGAAGATGAATTGGATAC
ACCTCCATTTTTCAAAAATCGT
```

SP074 amino acid (SEQ ID NO:124)
FGFEGSKRGQFAVEGINQLREHVDTLLIISNNNLLEIVDKKTPLLEALSEADNVLRQGVQGITDLITNP
GLINLDFADVKTVMANKGNALMGIGIGSGEERVVEAARKAIYSPLLETTIDGAEDVIVNVTGGLDLTLI
EAEEASQIVNQAAGQGVNIWLGTSIDESMRDEIRVTVVATGVRQDRVEKVVAPQARSATNYRETVKPAH
SHGFDRHFDMAETVELPKQNPRRLEPTQASAFGDWDLRRESIVRTTDSVVSPVERFEAPISQDEDELDT
PPFFKNR SP075 nucleotide (SEQ ID NO:121)
```
CTACTACCTCTCGAGAGAAAGTGACCTAGAGGTGACCGTTTTTGACCATGAGCAAGGTCAAGCCACCAA
GGCCGCAGCAGGAATTATCAGTCCTTGGTTTTCCAAACGCCGTAATAAAGCCTGGTACAAGATGGCGCG
CTTGGGGGCTGATTTTTATGTGGATTTATTAGCTGATTTAGAGAAATCAGGACAAGAAATCGACTTTTA
CCAGCGTTCGGGAGTCTTTCTCTTGAAAAAGGATGAATCCAATTTGGAAGAACTTTATCAACTGGCCCT
CCAGCGCAGAGAAGAATCTCCCTTGATAGGGCAATTAGCCATTCTGAACCAGGCCTCAGCTAATGAATT
ATTCCCTGGTTTGCAGGGATTTGACCGCCTGCTCTATGCTTCTGGTGGAGCGAGAGTAGATGGCCAACT
TTTAGTGACTCGTTTGCTGGAAGTCAGTCATGTCAAGCTGGTCAAAGAAAAAGTGACTCTGACACCGTT
AGCATCAGGCTACCAGATTGGTGAAGAGGAGTTTGAGCAGGTTATTTTGGCGACGGGAGCTTGGTTGGG
GGACATGTTAGAGCCTTTAGGTTATGAAGTGGATGTCCGTCCTCAAAAAGGACAACTACGAGATTATCA
GCTTGCCCAAGACATGGAAGATTACCCTGTTGTCATGCCAGAAGGGGAGTGGGATTTGATTCCCTTTGC
AGGTGGGAAATTATCCTTAGGCGCTACCCACGAAATGACATGGGATTTGATTTGACGGTAGATGAAAC
CTTGCTCCAACAAATGGAGGAGGCCACCTTGACTCACTATCTGATTTTGGCTGAAGCTACTTCAAAATC
TGAGCGTGTTGGAATCCGTGCCTACACCAGTGATTTCTCTCCTTTCTTTGGGCAGGTGCCTGACTTAAC
TGGTGTCTATGCAGCCAGTGGACTAGGTTCATCAGGCCTCACAACTGGTCCTATCATTGGTTACCATCT
AGCCCAACTGATCCAAGACAAGGAGTTGACCTTGGACCCTCTAAATTACCCAATTGAAAACTATGTCAA
ACGAGTAAAAAGCGAA
```

SP075 amino acid (SEQ ID NO:126)
YYLSRESDLEVTVFDHEQGQATKAAAGIISPWFSKRRNKAWYKMARLGADFYVDLLADLEKSGQEIDFY
QRSGVFLLKKDESNLEELYQLALQRREESPLIGQLAILNQASANELFPGLQGFDRLLYASGGARVDGQL
LVTRLLEVSHVKLVKEKVTLTPLASGYQIGEEEFEQVILATGAWLGDMLEPLGYEVDVRPQRGQLRDYQ
LAQDMEDYPVVMPEGEWDLIPFAGGKLSLGATHENDMGFDLTVDETLLQQMEEATLTHYLILAEATSKS
ERVGIRAYTSDFSPFFGQVPDLTGVYAASGLGSSGLTTGPIIGYHLAQLIQDKELTLDPLNYPIENYVK
RVKSE SP076 nucleotide (SEQ ID NO:127)
```
TAAGGTCAAAAGTCAGACCGCTAAGAAAGTGCTAGAAAAGATTGGAGCTGACTCGGTTATCTCGCCAGA
GTATGAAATGGGGCAGTCTCTAGCACAGACCATTCTTTTCCATAATAGTGTTGATGTCTTTCAGTTGGA
TAAAAATGTGTCTATCGTGGAGATGAAAATTCCTCAGTCTTGGGCAGGTCAAAGTCTGAGTAAATTAGA
CCTCCGTGGCAAATACAATCTGAATATTTTGGGTTTCCGAGAGCAGGAAAATTCCCCATTGGATGTTGA
ATTTGGACCAGATGACCTCTTGAAAGCAGATACCTATATTTTGGCAGTCATCAACAACCAGTATTTGGA
TACCCTA
```

SP076 amino acid (SEQ ID NO:128)
KVKSQTAKKVLEKIGADSVISPEYEMGQSLAQTILFHNSVDVFQLDKNVSIVEMKIPQSWAGQSLSKLD
LRGKYNLNILGFREQENSPLDVEFGPDDLLKADTYILAVINNQYLDTL SP077 nucleotide (SEQ ID NO:129)
```
TGACGGGTCTCAGGATCAGACTCAGGAAATCGCTGAGTGTTTAGCTAGCAAGTATCCTAATATCGTTAG
AGCCATCTATCAGGAAAATAAATGCCATGGCGGTGCGGTCAATCGTGGCTTGGTAGAGGCTTCTGGGCG
CTATTTTAAAGTAGTTGACAGTGATGACTGGGTGGATCCTCGTGCCTACTTGAAAATTCTTGAAACTTG
CAGGAACTTGAGAGCAAAGGTCAAGAGGTGGATGTCTTTG
```

SP077 amino acid (SEQ ID NO:130)
DGSQDQTQEIAECLASKYPNIVRAIYQENKCHGGAVNRGLVEASGRYFRVVDSDDWVDPRAYLKILETC
RNLRAKVKRWMSL SP078 nucleotide (SEQ ID NO:131)
```
TAGAGGCTTTGCCAAATGGTGGGAAGGGCACGAGCGTCGAAAAGAGGAACGCTTTGTCAAACAAGAAGA
AAAAGCTCGCCAAAAGGCTGAGAAAGAGGCTAGATTAGAACAAGAAGAGACTGAAAAAGCCTTACTCGA
TTTGCCTCCTGTTGATATGGAAACGGGTGAAATTCTGACAGAGGAAGCTGTTCAAAATCTTCCACCTAT
TCCAGAAGAAAAGTGGGTGGAACCAGAAATCATCCTGCCTCAAGCTGAACTTAAATTCCCTGAACAGGA
AGATGACTCAGATGACGAAGATGTTCAGGTCGATTTTTCAGCCAAAGAAGCCCTTGAATACAAACTTCC
AAGCTTACAACTCTTTGCACCAGATAAACCAAAAGATCAGTCTAAAGAGAAGAAAATTGTCAGAGAAAA
TATCAAAATCTTAGAAGCAACCTTTGCTAGCTTTGGTATTAAGGTAAGAGTTGAACGGGCCGAAATTGG
GCCATCAGTGACCAAGTATGAAGTCAAGCCGGCTGTTGGTGTAAGGGTCAACCGCATTTCCAATCTATC
AGATGACCTCGCTCTAGCCTTGGCTGCCAAAGATGTCCGGATTGAAGCACCAATCCCTGGGAAATCCCT
AATCGGAATTGAAGTGCCCAACTCCGATATTGCCACTGTATCTTTCCGAGAACTATGGGAACAATCGCA
AACGAAAGCAGAAAATTTCTTGGAAATTCCTTTAGGGAAGGCTGTTAATGGAACCGCAAGAGCTTTTGA
```

TABLE 1-continued

```
CCTTTCTAAAATGCCCCACTTGCTAGTTGCAGGTTCAACGGGTTCAGGGAAGTCAGTAGCAGTTAACGG
CATTATTGCTAGCATTCTCATGAAGGCGAGACCAGATCAAGTTAAATTTATGATGGTCGATCCCAAGAT
GGTTGAGTTATCTGTTTACAATGATATTCCCCACCTCTTGATTCCAGTCGTGACCAATCCACGCAAAGC
CAGCAAGGCTCTGCAAAAGGTTGTGGATGAAATGGAAAACCGTTATGAACTCTTTGCCAAGGTGGGAGT
TCGGAATATTGCAGGTTTTAATGCCAAGGTAGAAGAGTTCAATTCCCAGTCTGAGTACAAGCAAATTCC
GCTACCATTCATTGTCGTGATTGTGGATGAGTTGGCTGACCTCATGATGGTGGCCAGCAAGGAAGTGGA
AGATGCTATCATCCGTCTTGGGCAGAAGGCGCGTGCTGCAGGTATCCACATGATTCTTGCAACTCAGCG
TCCATCTGTTGATGTCATCTCTGGTTTGATTAAGGCCAATGTTCCATCTCGTGTAGCATTTGCGGTTTC
ATCAGGAACAGACTCCCGTACGATTTTGGATGAAAATGGAGCAGAAAAACTTCTTGGTCGAGGAGACAT
GCTCTTTAAACCGATTGATGAAAATCATCCAGTTCGTCTCCAAGGCTCCTTTATCTCGGATGACGATGT
TGAGCGCATTGTGAACTTCATCAAGACTCAGGCAGATGCAGACTACGATGAGAGTTTTGATCCAGGTGA
GGTTTCTGAAAATGAAGGAGAATTTTCGGATGGAGATGCTGGTGGTGATCCGCTTTTTGAAGAAGCTAA
GTCTTTGGTTATCGAAACACAGAAAGCCAGTGCGTCTATGATTCAGCGTCGTTTATCAGTTGGATTTAA
CCGTGCGACCCGTCTCATGGAAGAACTGGAGATAGCAGGTGTCATCGGTCCAGCTGAAGGTACCAAACC
TCGAAAAGTGTTACAACAA
```

SP078 amino acid (SEQ ID NO:132)
RGFAKWWEGHERRKEERFVKQEEKARQKAEKEARLEQEETEKALLDLPPVDMETGEILTEEAVQNLPPI
PEEKWVEPEIILPQAELKFPEQEDDSDDEDVQVDFSAKEALEYKLPSLQLFAPDKPKDQSKEKKIVREN
IKILEATFASFGIKVTVERAEIGPSVTKYEVKPAVGVRVNRISNLSDDLALALAAKDVRIEAPIPGKSL
IGIEVPNSDIATVSFRELWEQSQTKAENFLEIPLGKAVNGTARAFDLSKMPHLLVAGSTGSGKSVAVNG
IIASILMKARPDQVKFMMVDPKMVELSVYNDIPHLLIPVVTNPRKASKALQKVVDEMENRYELFAKVGV
RNIAGFNAKVEEFNSQSEYKQIPLPFIVVIVDELADLMMVASKEVEDAIIRLGQKARAAGIHMILATQR
PSVDVISGLIKANVPSRVAFAVSSGTDSRTILDENGAEKLLGRGDMLFKPIDENHPVRLQGSFISDDDV
ERIVNFIKTQADADYDESFDPGEVSENEGEFSDGDAGGDPLFEEAKSLVIETQKASASMTQRRLSVGFN
RATRLMEELEIAGVIGPAEGTKPRKLQQ SP079 nucleotide (SEQ ID NO:133)
```
TCAAAAAGAGAAGGAAAACTTGGTTATTGCTGGGAAAATAGGTCCAGAACCAGAAATTTTGGCCAATAT
GTATAAGTTGCTGATTGAAGAAATACCAGCATGACTGCGACTGTTAAACCGAATTTTGGGAAGACAAG
CTTCCTTTATGAAGCTCTGAAAAAAGGCGATATTGACATCTATCCTGAATTTACTGGTACGGTGACTGA
AAGTTTGCTTCAACCATCACCCAAGGTGAGTCATGAACCAGAACAGGTTTATCAGGTGGCGCGTGATGG
CATTGCTAAGCAGGATCATCTAGCCTATCTCAAACCCATGTCTTATCAAAACACCTATGCTGTAGCTGT
TCCGAAAAAGATTGCTCAAGAATATGGCTTGAAGACCATTTCAGACTTGAAAAAAGTGGAAGGGCAGTT
GAAGGCAGGTTTTACACTCGAGTTTAACGACCGTGAAGATGGAAATAAGGGCTTGCAATCAATGTATGG
TCTCAATCTCAATGTAGCGACCATTGAGCCAGCCCTTCGCTATCAGGCTATTCAGTCAGGGGATATTCA
AATCACGGATGCCTATTCGACTGATGCGGAATTGGAGCGTTATGATTTACAGGTCTTGGAAGATGACAA
GCAACTCTTCCCACCTTATCAAGGGGCTCCACTCATGAAGAAGCTCTTCTCAAGAAACACCCAGAGTT
GGAAAGAGTTCTTAATACATTGGCTGGTAAGATTACAGAAAGCCAGATGAGCCAGCTCAACTACCAAGT
CGGTGTTGAAGCCAAGTCAGCAAAGCAAGTAGCCAAGGAGTTTCTCCAAGAACAAGGTTTGTTGAAGAA
A
```

SP079 amino acid (SEQ ID NO:134)
QKEKENLVIAGKIGPEPEILANMYKLLIEENTSMTATVKPNFGKTSFLYEALKKGDIDIYPEFTGTVTE
SLLQPSPKVSHEPEQVYQVARDGIAKQDHLAYLKPMSYQNTYAVAVPKKIAQEYGLKTISDLKKVEGQL
KAGFTLEFNDREDGNKGLQSMYGLNLNVATIEPALRYQAIQSGDIQITDAYSTDAELERYDLQVLEDDK
QLFPPYQGAPLMKEALLKKHPELERVLNTLAGKITESQMSQLNYQVGVEGKSAKQVAKEFLQEQGLLKK SP080 nucleotide (SEQ ID NO:135)
```
ACGTTCTATTGAGGACCACTTTGATTCAAACTTCGAATTGGAATATAACCTCAAAGAAAAAGGGAAAAC
AGATCTTTTGAAGCTAGTTGATAAAACAACTGACATGCGTCTGGATTTTATCCGCCAAACTCATCCACG
CGGTCTCGGAGATGCTGTTTTGCAAGCCAAGGCTTTCGTCGGAAATGAACCTTTTGTCGTTATGCTTGG
TGATGACTTGATGGATATCACAGACGAAAAGGCTGTTCCACTTACCAAACAACTCATGGATGACTACGA
GCGTACCCACGCGTCTACTATCGCTGTCATGCCAGTCCCTCATGACGAAGTATCTGCTTACGGGGTTAT
TGCTCCGCAAGGCGAAGGAAAAGATGGTCTTTACAGTGTTGAAACCTTTGTTGAAAAACCAGCTCCAGA
GGACGCTCCTAGCGACCTTGCTATTATCGGACGCTACCTCCTCACGCCTGAAATTTTTGAGATTCTCGA
AAAGCAAGCTCCACGTGCAGGAAATGAAATTCAGCTGACAGATGCAATCGACACCCTCAATAAAACACA
ACGTGTATTTGCTCGTGAGTTCAAAGGGGCTCGTTACGATGTCGGAGACAAGTTTGGCTTCATGAAAAC
ATCCATCGACTACGCCCTCAAACACCCCACAAGTCAAAGATGATTTGAAGAATTACCTCATCCAACTTGG
AAAAGAATTGACTGAGAAGGAA
```

SP080 amino acid (SEQ ID NO:136)
RSIEDHFDSNFELEYNLKEKGKTDLLKLVDKTTDMRLHFIRQTHPRGLGDAVLQAKAFVGNEPFVVMLG
DDLMDITDEKAVPLTKQLMDDYERTHASTIAVMPVPHDEVSAYGVIAPQGEGKDGLYSVETFVEKPAPE
DAPSDLAIIGRYLLTPEIFEILEKQAPGAGNEIQLTDAIDTLNKTQRVFAREFKGARYDVGDKFGFMKT
SIDYALKHPQVKDDLKNYLIQLGKELTEKE SP081 nucleotide (SEQ ID NO:137)
```
CGCTCAAAATACCAGAGGTGTTCAGCTAATCGAGCACGTTTCTCCTCAAATGTTGAAAGCCCAATTGGA
GAGTGTCTTTTCTGATATTCCACCTCAGGCTGTAAAAACTGGAATGTTGGCTACTACTGAAATCATGGA
AATCATCCAACCCTATCTTAAAAAACTGGATTGTCCCTATGTCCTTGATCCTGTTATGGTTGCTACAAG
TGGAGATGCCTTGATTGACTCAAATGCTAGAGACTATCTCAAACAAACTTACTACCTCTAGCAACTAT
TATTACGCCAAATCTTCCTGAAGCAGAAGAGATTGTTGGTTTTTCAATCCATGACCCCGAAGACATGCA
GCGTGCTGGTCGCCTGATTTTAAAAGAATTTGGTCCTCAGTCTGTGGTTATCAAAGGCGGACATCTCAA
AGGTGGTGCTAAAGATTTCCTCTTTACCAAGAATGAACAATTTGTCTGGGAAAGCCCACGAATTCAAAC
CTGTCACACCCATGGTACT
```

SP081 amino acid (SEQ ID NO:138)
AQNTRGVQLIEHVSPQMLKAQLESVFSDIPPQAVKTGMLATTEIMEIIQPYLKKLDCPYVLDPVMVATS TABLE 1-continued GDALIDSNARDYLKTNLLPLATIITPNLPEAEEIVGFSIHDPEDMQRAGRLILKEFGPQSVVIKGGHLK
GGAKDFLFTKNEQFVWESPRIQTCHTHGT SP082 nucleotide (SEQ ID NO:139)
AATTGTACAATTAGAAAAAGATAGCAAATCAGACAAAGAACAAGTTGATAAACTATTTGAATCATTTGA
TGCATCTTCAGATGAATCTATTTCTAAATTAAAAGAACTATCTGAAACTTCACTTAAAACCGATGCAGG
TAAAGACTATCTTAATAACAAAGTCAAAGAATCATCTAAAGCAATTGTAGATTTTCATTTGCAAAAAGG
TTTGGCTTATGATGTTAAAGATTCAGATGACAAATTTAAAGATAAAGCAACTCTTGAAACAAATGTAAA
AGAAATTACAAAACAAATTGATTTTATCAAAAAAGTTGATGAAACTTTTAAACAAGAGAATTTGGAAGA
AACTCTTAAATCTCTAAATGATCTTGTTGATAAATATCAAAAACAAATCGAACTTTTGAAGAAAGAAGA
AGAAAAAGCTGCTGAAAAAGCTGCTGAAAAAGCAAAGGAATCTTCTAGTCAAAGTAATTCTTCTGGTAG
TGCTTCTAATGAGTCTTATAATGGATCTTCCAATTCAAATGTAGATTTATAGTTCATCTGAACAAACTAA
TGGATATTCAAATAATTATGGCGGTCAAGATTATTCTGGTTCAGGAGATAGTTCAACAAATGGTGGATC
ATCAGAACAATATTCATCTAGCAATTCAAACAGCGGAGCAAATAATGTCTACAGATATAAAGGCACTGG
TGCTGACGGCTATCAAAGATACTACTACAAAGATCATAATAATGGAGATGTGTATGATGACGATGGAAA
TTACCTTGGGAACTTTGGTGGCGGCATTGCAGAACCTAGTCAACGC SP082 amino acid (SEQ ID NO:140)
IVQLEKDSKSDKEQVDKLFESFDASSDESISKLKELSETSLKTDAGKDYLNNKVKESSKAIVDFHLQKG
LAYDVKDSDDKFKDKATLETNVKEITKQIDFIKKVDETFKQENLEETLKSLNDLVDKYQKQIELLKKEE
EKAAEKAAEKAKESSSQSNSSGSASNESYNGSSNSNVDYSSSEQTNGYSNNYGGQDYSGSGDSSTNGGS
SEQYSSSNSNSGANNVYRYKGTGADGYQRYYYKDHNNGDVYDDDGNYLGNFGGGIAEPSQR SP083 nucleotide (SEQ ID NO:141)
TCTGACCAAGCAAAAAGAAGCAGTCAATGACAAAGGAAAAGCAGCTGTTGTTAAGGTGGAGAAAAGCCA
GGCAGAACTTTATAGCTTAGAAAAAGAATGAAGATGCTAGCCTAAGAAAGTTACAAGCAGATGGACGCAT
CACGGAAGAACAGGCTAAAGCTTATAAAGAATACAATGATAAAAATGGAGGAGCAAATCGTAAAGTCAA
TGAT SP083 amino acid (SEQ ID NO:142)
LTKQKEAVNDKGKAAVVKVVESQAELYSLEKNEDASLRKLQADGRITEEQAKAYKEYNDKNGGANRKVN
D SP084 nucleotide (SEQ ID NO:143)
GTCCGGCTCTGTCCAGTCCACTTTTTCAGCGGTAGAGGAACAGATTTTCTTTATGGAGTTTGAAGAACT
CTATCGGGAAACCCAAAAACGCAGTGTAGCCAGTCAGCAAAAGACTAGTCTGAACTTAGATGGGCAGAC
GCTTAGCAATGGCAGTCAAAAGTTGCCAGTCCCTAAAGGAATTCAGGCCCCATCAGGCCAAAGTATTAC
ATTTGACCGAGCTGGGGGCAATTCGTCCCTGGCTAAGGTTGAATTTCAGACCAGTAAAGGAGCGATTCG
CTATCAATTATATCTAGGAAATGGAAAAATTAAACGCATTAAGGAAACAAAAAAT SP084 amino acid (SEQ ID NO:144)
SGSVQSTFSAVEEQIFFMEFEELYRETQKRSVASQQKTSLNLDGQTLSNGSQKLPVPKGIQAPSGQSIT
FDRAGGNSSLAKVEFQTSKGAIRYQLYLGNGKIKRIKETKN SP085 nucleotide (SEQ ID NO:145)
GGGACAAATTCAAAAAAATAGGCAAGAGGAAGCAAAAATCTTGCAAAAGGAAGAAGTCTTGAGGGTAGC
TAAGATGGCCCTGCAGACGGGGCAAAATCAGGTAAGCATCAACGGAGTTGAGATTCAGGTATTTTCTAG
TGAAAAAGGATTGGAGGTCTACCATGGTTCAGAACAGTTGTTGGCAATCAAAGAGCCA SP085 amino acid (SEQ ID NO:146)
GQIQKNRQEEAKILQKEEVLRVAKMALQTGQNQVSINGVEIQVFSSEKGLEVYHGSEQLLAIKEP SP086 nucleotide (SEQ ID NO:147)
TCGCTACCAGCAACAAAGCGAGCAAAAGGAGTGGCTCTTGTTTGTGGACCAACTTGAGGTAGAATTAGA
CCGTTCGCAGTTCGAAAAAGTAGAAGGCAATCGCCTATACATGAAGCAAGATGGCAAGGACATCGCCAT
CGGTAAGTCAAAGTCAGATGATTTCCGTAAAACGAATGCTCGTGGTCGAGGTTATCAGCCTATGGTTTA
TGGACTGAAATCTGTACGGATTACAGAGGACAATCAACTGGTTCGCTTTCATTTCCAGTTCCAAAAAGG
CTTAGAAAGGGAGTTCATCTATCGTGTGGAAAAAGAAAAAAGT SP086 amino acid (SEQ ID NO:148)
RYQQQSEQKEWLLFVDQLEVELDRSQFEKVEGNRLYMKQDGKDIAIGKSKSDDFRKTNAAGRGYQPMVY
GLKSVRITEDNQLVRFHFQFQKGLEREFIYRVEKEKS SP087 nucleotide (SEQ ID NO:149)
GAACCGACAAGTCGCCCACTATCAAGACTATGCTTTGAATAAAGAAAAATTGGTTGCTTTTGCTATGGC
TAAACGAACCAAAGATAAGGTTGAGCAAGAAAGTGGGGAACAGTTTTTTAATCTAGGTCAGGTAAGCTA
TCAAAACAAGAAAACTGGCTTAGTGACGAGGGTTCGTACGGATAAGAGCCAATATGAGTTTCTGTTTCC
TTCAGTCAAAATCAAAGAAGAGAAAAGAGATAAAAAGGAAGAGGTAGCGACCGATTCAAGCGAAAAAGT
GGAGAAGAAAAAATCAGAAGAGAAGCCTGAAAAGAAAGAGAATTCA SP087 amino acid (SEQ ID NO:150)
NRQVAHYQDYALNKEKLVAFAMAKRTKDKVEQESGEQFFNLGQVSYQNKKTGLVTRVRTDKSQYEFLFP
SVKIKEEKRDKKEEVATDSSEKVEKKKSEEKPEKKENS SP088 nucleotide (SEQ ID NO:151)
GGTTGTCGGCTGGCAATATATCCCGTTTCCATGTAAAGGTAGTACAATTGGTCCTTACCCAAATGGTAT
CAGATTAGAAGGTTTTCCAAAGTCAGAGTGGTACTACTTCGATAAAAATGGAGTGCTACAAGAGTTTGT
TGGTTGGAAAACATTAGAGATTAAAACTAAAGACAGTGTTGGAAGAAAGTACGGGGAAAAACGTGAAGA
TTCAGAAGATAAAGAAGAGAAGCGTTATTATACGAACTATTACTTTAATCAAAATCATTCTTTAGAGAC TABLE 1-continued

```
AGGTTGGCTTTATGATCAGTCTAACTGGTATTATCTAGCTAAGACGGAAATTAATGGAGAAAACTACCT
TGGTGGTGAAAGACGTGCGGGGTGGATAAACGATGATTCGACTTGGTACTACCTAGATCCAACAACTGG
TATTATGCAAACAGGTTGGCAATATCTAGGTAATAAGTGGTACTACCTCCGTTCCTCAGGAGCAATGGC
CACTGGCTGGTATCAGGAAGGTACCACTTGGTATTATTTAGACCACCCAAATGGCGATATGAAAACAGG
TTGGCAAAACCTTGGGAACAAATGGTACTATCTCCGTTCATCAGGAGCTATGGCAACTGGTTGGTATCA
AGATGGTTCAACTTGGTACTACCTAAATGCAGGTAATGGAGACATGAAGACAGGTTGGTTCCAGGTCAA
TGGCAACTGGTACTATGCTTATAGCTCAGGTGCTTTGGCAGTGAATACGACCGTAGATGGCTATTCTGT
CAACTATAATGGCGAATGGGTTCGG

SP088 amino acid (SEQ ID NO:152)
VVGWQYIPFPSKGSTIGPYPNGIRLEGFPKSEWYYFDKNGVLQEFVGWKTLEIKTKDSVGRKYGEKRED
SEDKEEKRYYTNYYFNQNHSLETGWLYDQSNWYYLAKTEINGENYLGGERRAGWINDDSTWYYLDPTTG
IMQTGWQYLGNKWYYLRSSGAMATGWYQEGTTWYYLDHPNGDMKTGWQNLGNKWYYLRSSGAMATGWYQ
DGSTWYYLNAGNGDMKTGWFQVNGNWYYAYSSGALAVNTTVDGYSVNYNGEWVR SP089 nucleotide (SEQ ID NO:153)
GGCCAAATCAGAATGGGTAGAAGACAAGGGAGCCTTTTATTATCTTGACCAAGATGGAAAGATGAAAAG
AAATGCTTGGGTAGGAACTTCCTATGTTGGTGCAACAGGTGCCAAAGTAATAGAAGACTGGGTCTATGA
TTCTCAATACGATGCTTGGTTTTATATCAAAGCAGATGGACAGCACGCAGAGAAAGAATGGCTCCAAAT
TAAAGGGAAGGACTATTATTTCAAATCCGGTGGTTATCTACTGACAAGTCAGTGGATTAATCAAGCTTA
TGTGAATGCTAGTGGTGCCAAAGTACAGCAAGGTTGGCTTTTTGACAAACAATACCAATCTTGGTTTTA
CATCAAAGAAAATGGAAACTATGCTGATAAAGAATGGATTTTCGAGAATGGTCACTATTATTATCTAAA
ATCCGGTGGCTACATGGCAGCCAATGAATGGATTTGGGATAAGGAATCTTGGTTTTATCTCAAATTTGA
TGGGAAAATGGCTGAAAAAGAATGGGTCTACGATTCTCATAGTCAAGCTTGGTACTACTTCAAATCCGG
TGGTTACATGACAGCCAATGAATGGATTTGGGATAAGGAATCTTGGTTTTATCTCAAATCTGATGGGAA
AATAGCTGAAAAGAATGGGTCTACGATTCTCATAGTCAAGCTTGGTACTACTTCAAATCCGGTGGTTA
CATGACAGCCAATGAATGGATTTGGGATAAGGAATCTTGGTTTTACCTCAAATCTGATGGGAAAATAGC
TGAAAAGAATGGGTCTACGATTCTCATAGTCAAGCTTGGTACTACTTCAAATCTGGTGGCTACATGGC
GAAAAATGAGACAGTAGATGGTTATCAGCTTGGAAGCGATGGTAAATGGCTTGGAGGAAAAACTACAAA
TGAAAATGCTGCTTACTATCAAGTAGTGCCTGTTACAGCCAATGTTTATGATTCAGATGGTGAAAAGCT
TTCCTATATATCGCAAGGTAGTGTCGTATGGCTAGATAAGGATAGAAAAAGTGATGACAAGCGCTTGGC
TATTACTATTTCTGGTTTGTCAGGCTATATGAAAACAGAAGATTTACAAGCGCTAGATGCTAGTAAGGA
CTTTATCCCTTATTATGAGAGTGATGGCCACCGTTTTTATCACTATGTGGCTCAGAATGCTAGTATCCC
AGTAGCTTCTCATCTTTCTGATATGGAAGTAGGCAAGAAATATTATTCGGCAGATGGCCTGCATTTTGA
TGGTTTTAAGCTTGAGAATCCCTTCCTTTTCAAAGATTTAACAGAGGCTACAAACTACAGTGCTGAAGA
ATTGGATAAGGTATTTAGTTTGCTAAACATTAACAATAGCCTTTTGGAGAACAAGGGCGCTACTTTTAA
GGAAGCCGAAGAACATTACCATATCAATGCTCTTTATCTCCTTGCCCATAGTGCCCTAGAAAGTAACTG
GGGAAGAAGTAAAATTGCCAAAGATAAGAATAATTTCTTTGGCATTACAGCCTATGATACGACCCCTTA
CCTTTCTGCTAAGACATTTGATGATGTGGATAAGGGAATTTTAGGTGCAACCAAGTGGATTAAGGAAAA
TTATATCGATAGGGGAAGAACTTTCCTTGGAAACAAGGCTTCTGGTATGAATGTGGAATATGCTTCAGA
CCCTTATTGGGCGAAAAAATTGCTAGTGTGATGATGAAAATCAATGAGAAG SP089 amino acid (SEQ ID NO:154)
AKSEWVEDKGAFYYLDQDGKMKRNAWVGTSYVGATGAKVIEDWVYDSQYDAWFYIKADGQHAEKEWLQI
KGKDYYFKSGGYLLTSQWINQAYVNASGAKVQGGWLFDKQYQSWFYIKENGNYADKEWIFENGHYYYLK
SGGYMAANEWIWDKESWWYLKFDGKMAEKEWVYDSHSQAWYYFKSGGYMTANEWIWDKESWFYLKSDGK
IAEKEWVYDSHSQAWYYFKSGGYMTANEWIWDKESWFYLKSDGKIAEKEWVYDSHSQAWYYFKSGGYMA
KNETVDGYQLGSDGKWLGGKTTNENAAYYQVVVVTANVYDSDGEKLSYISQGSVVWLDKDRKSDDKRLA
ITISGLSGYMKTEDLQALDASKDFIPYYESDGHRFYHYVAQNASIPVASHLSDMEVGKKYYSADGLHFD
GFKLENPFLFKDLTEATNYSAEELDKVFSLLNINNSLLENKGATFKEAEEHYHINALYLLAHSALESNW
GRSKIAKDKNNFFGITAYDTTPYLSAKTFDDVDKGILGATKWIKENYIDRGRTFLGNKASGMNVEYASD
PYWGEKIASVMMKINEK SP090 nuclectide (SEQ ID NO:155)
ATTTGCAGATGATTCTGAAGGATGGCAGTTTGTCCAAGAAAATGGTAGAACCTACTACAAAAAGGGGGA
TCTAAAAGAAACCTACTGGAGAGTGATAGATGGGAAGTACTATTATTTTGATCCTTTATCCGGAGAGAT
GGTTGTCGGCTGGCAATATATACCTGCTCCACACAAGGGGGTTACGATTGGTCCTTCTCCAAGAATAGA
GATTGCTCTTAGACCAGATGGTTTTATTTTGGTCAAGATGGTGTATTACAAGAATTTGTTGGCAAGCA
AGTTTTAGAAGCAAAAACTGCTACGAATACCAACAAACATCATGGGAAGAATATGATAGCCAAGCAGA
GAAACGAGTCTATTATTTTGAAGATCAGCGTAGTTATCATACTTTAAAAACTGGTTGGATTTATGAAGA
GGGTCATTGGTATTATTTACAGAAGGATGGTGGCTTTGATTCGCGCATCAACAGATTGACGGTTGGAGA
GCTAGCACGTGGTTGGGTTAAGGATTACCCTCTTACGTATGATGAAGAGAAGCTAAAAGCAGCTCCATG
GTACTATCTAAATCCAGCAACTGGCATTATGCAAACAGGTTGGCAATATCTAGGTAATAGATGGTACTA
CCTCCATTCGTCAGGAGCTATGGCAACTGGCTGGTATAAGGAAGGCTCAACTTGGTACTATCTAGATGC
TGAAAATGGTGATATGAGAACTGGCTGGCAAAACCTTGGGAACAAATGGTACTATCTCCGTTCATCAGG
AGCTATGGCAACTGGTTGGTATCAGGAAAGTTCGACTTGGTACTATCTAAATGCAAGTAATGGAGATAT
GAAAACAGGCTGGTTCCAAGTCAATGGTAACTGGTACTATGCCTATGATTCAGGTGCTTTAGCTGTTAA
TACCACAGTAGGTGGTTACTACTTAAACTATAATGGTGAATGGGTTAAG SP090 amino acid (SEQ ID NO:156)
VFADDSEGWQFVQENGRTYYKKGDLKETYWRVIDGKYYYFDPLSGEMVVGWQYIPAPHKGVTIGPSPRI
EIALRPDWFYPGQDGVLQEFVGKQVLEAKTATNTNKHHGEEYDSQAEKRVYYFEDQRSYHTLKTGWIYE
EGHWYYLQKDGGFDSRINRLTVGELARGWVKDYPLTYDEEKLKAAPWYYLNPATGIMQTGWQYLGNRWY
YLHSSGAMATGWYKEGSTWYYLDAENGDMRTGWQNLGNKWYYLRSSGAMATGWYQESSTWYYLNASNGD
MKTGWFQVNGNWYYAYDSGALAVNITVGGYYLNYNGEWVK SP091 nucleotide (SEQ ID NO:157)
TGTCGCTGCAAATGAAACTGAAGTAGCAAAAACTTCGCAGGATACAACGACAGCTTCAAGTAGTTCAGA
GCAAAATCAGTCTTCTAATAAAACGCAAACGAGCGCAGAAGTACAGACTAATGCTGCTGCCCACTGGGA
```

TABLE 1-continued

```
TGGGGATTATTATGTAAAGGATGATGGTTCTAAAGCTCAAAGTGAATGGATTTTTGACAACTACTATAA
GGCTTGGTTTTATATTAATTCAGATGGTCGTTACTCGCAGAATCAATGGCATGGAAATTACTACCTGAA
ATCAGGTGGATATATGGCCCAAAACGAGTGGATCTATGACAGTAATTACAAGAGTTGGTTTTATCTCAA
GTCAGATGGGGCTTATGCTCATCAAGAATGGCAATTGATTGGAAATAAGTGGTACTACTTCAAGAAGTG
GGGTTACATGGCTAAAAGCCAATGGCAAGGAAGTTATTTCTTGAATGGTCAAGGAGCTATGATGCAAAA
TGAATGGCTSCTATGATCCAGCCTATTCTGCTTATTTTTATCTAAAATCCGATGGAACTTATGCTAACC
AAGAGTGGCAAAAAGTGGGCGGCAAATGGTACTATTTCAAGAAGTGGGGCTATATGGCTCGGAATGAGT
GGCAAGGCAACTACTATTTGACTGGAAGTGGTGCCATGGCGACAAGTGATTATGGATGGTACTC
GCTATATCTTTGCGGCCTCTGGTGAGCTCAAAGAAAAAAAAGATTTGAATGTCGGCTGGGTTCACAGAG
ATGGTAAGCGCTATTTCTTTAATAATAGAGAAGAACAAGTGGGAACCGAACATGCTAAGAAAGTCATTG
ATATTAGTGAGCACAATGGTCGTATCAATGATTGGAAAAAGGTTATTGATGAGAACGAAGTGGATGGTG
TCATTGTTCGTCTAGGTTATAGCGGTAAAGAAGACAAGGAATTGGCGCATAACATTAAGGAGTTAAACC
GTCTGGGAATTCCTTATGGTGTCTATCTCTATACCTATGCTGAAAATGAGACCGATGCTGAGAGTGACG
CTAAACAGACCATTGAACTTATAAAGAAATACAATATGAACCTGTCTTACCCTATCTATTATGATGTTG
AGAATTGGGAATATGTAAATAAGAGCAAGAGAGCTCCAAGTGATACAGGCACTTGGGTTAAAATCATCA
ACAAGTACATGGACACGATGAAGCAGGCGGGTTATCAAAATGTGTATGTCTATAGCTATCGTAGTTTAT
TACAGACGCGTTTAAAACACCCAGATATTTTAAAACATGTAAACTGGGTAGCGGCCTATACGAATGCTT
TAGAATGGGAAAACCCTCATTATTCAGGAAAAAAAGGTTGGCAATATACCTCTTCTGAATACATGAAAG
GAATCCAAGGGCGCGTAGATGTCAGCGTTTGGTAT

SP091 amino acid (SEQ ID NO:158)
VAANETEVAKTSQDTTTASSSSEQNQSSNKTQTSAEVQTNAAAHWDGDYYVKDDGSKAQSEWIFDNYYK
AWFYINSDGRYSQNEWHGNYYLKSGGYMAQNEWIYDSNYKSWFYLKSDGAYAHQEWQLIGNKWYYFKKW
GYMAKSQWQGSYFLNGQGAMMQNEWLYDPAYSAYFYLKSDGTYANQEWQKVGGKWYYFKKWGYMARNEW
QGNYYLTGSGAMATDEVIMDGTRYIFAASGELKEKKDLNVGWVHRDGKRYFFNNREEQVGTEHAKKVID
ISEHNGRINDWKKVIDENEVDGVIVRLGYSGKEDKELAHNIKELNRLGIPYGVYLYTYAENETDAESDA
KQTIELIKKYNMNLSYPIYYDVENWEYVNKSKRAPSDTGTWVKIINKYMDTMKQAGYQNVYVYSYRSLL
QTRLKHPDILKHVNWVAAYTNALEWENPHYSGKKGWQYTSSEYMKGIQGRVDVSVWY SP092 nucleotide (SEQ ID NO:159)
TACGTCTCAGCCTACTTTTGTAAGAGCAGAAGAATCTCCACAAGTTGTCGAAAAATCTTCATTAGAGAA
GAAATATGAGGAAGCAAAAGCAAAAGCTGATACTGCCAAGAAAGATTACGAAACGGCTAAAAAGAAAGC
AGAAGACGCTCAGAAAAAGTATGAAGATGATCAGAAAGAGAACTGAGGAGAAAGCTCGAAAAGAAGCAGA
AGCATCTCAAAAATTGAATGATGTGGCGCTTGTTGTTCAAAATGCATATATAAAGAGTACCGAGAAGTTCA
AAATCAACGTAGTAAATATAAATCTGACGCTGAATATCAGAAAAATTAACAGAGGTCGACTCTAAAAT
AGAGAAGGCTAGGAAAGAGCAACAGGACTTGCAAAATAAATTTAATGAAGTAAGAGCAGTTGTAGTTCC
TGAACCAAATGCGTTGGCTGAGACTAAGAAAAAAGCAGAAGAAGCTAAAGCAGAAGAAAAAATAGCTAA
GAGAAAATATGATTATGCAACTCTAAAGGTAGCACTAGCGAAGAAAGAAGTAGAGGCTAAGGAACTTGA
AATTGAAAAACTTCAATATGAAATTTCTACTTTGGAACAAGAAGTTGCTACTGCTCAACATCAAGTAGA
TAATTTGAAAAAACTTCTTGCTGGTGCGGATCCTGATGATGGCACAGAAGTTATAGAAGCTAAATTAAA
AAAAGGAGAAGCTGAGCTAAACGCTAAACAAGCTGAGTTAGCAAAAAACAAACAGACTTGAAAAACT
TCTTGACAGCCTTTATCCTCAAGGTAAGACTCAGGATGAATTAGATAAAGAAGCAGAAGAAGCTGAGTT
GGATAAAAAGCTGATGAACTTCAAAATAAAGTTGCTGATTTAGAAAAAGAAATTAGTAACCTTGAAAT
ATTACTTGGAGGGGCTGATNCTGAAGATGATACTGCTGCTCTTCAAAATAAATTAGCTACTAAAAAAGC
TGAATTGGAAAAAACTCAAAAAGAATTAGATGCAGCTCTTAATGAGTTAGGCCCTGATGGAGATGAAGA
AGAAACTCCAGCGCCGGCTCCTCAACCAGAGCAACCAGCTCCTGCACCAAAACCAGAGCAACCAGCTCC
AGCTCCAAAACCAGAGCAACCAGCTCCTGCACCAAAACCAGAGCAACCAGCTCCAGCTCCAAAACCAGA
GCAACCAGCTCCAGCTCCAAAACCAGAGCAACCAGCTAAGCCGGAGAAACCAGCTGAAGAGCCTACTCA
ACCAGAAAAACCAGCCACTCCAAAAACAGGCTGGAAACAAGAAACGGTATGTGGTATTTCTACAATAC
TGATGGTTCAATGGCAATAGGTTGGCTCCAAAACAACGGTTCATGGTACTACCTAAACGCTAACGGCGC
TATGGGAACAGGTTGGGTGAAAGATGGAGATACCTGGTACTATCTTGAAGCATGAGGTGGTATGAAAGC
AAGCCAATGGTTCAAAGTATCAGATAAATGGTACTATGTCAACAGCAATGGCGCTATGGCGACAGGCTG
GCTCCAATACAATGGCTCATGGTACTACCTCAACGCTAATGGTGATATGGCGACAGGATGGCTCCAATA
CAACGGTTCATGGTATTACCTCAACGCTAATGGTGATATGGCGACAGGATGGCTAAAGTCAACGGTTC
ATGGTACTACCTAAACGCTAACGGTGCTATGGCTACAGGTTGGGCTAAAGTCAACGGTTCATGGTACTA
CCTAAACGCTAACGGTTCAATGGCAACAGGTTGGGTGAAAGATGGAGATACCTGGTACTATCTTGAAGC
ATCAGGTGCTATGAAAGCAAGCCAATGGTTCAAAGTATCAGATAAATGGTACTATGTCAATGGCTTAGG
TGCCCTTGCAGTCAACACAACTGTAGATGGCTATAAAGTCAATGCCAATGGTGAATGGGTT SP092 amino acid (SEQ ID NO:160)
TSQPTFVRAEESPQVVEKSSLEKKYEEAKAKADTAKKDYETAKKKAEDAQKKYEDDQKRTEEKARKEAE
ASQKLNDVALVVQNAYKEYREVQNQRSKYKSDAEYQKKLTEVDSKIEKARKEQQDLQNKFNEVRAVVVP
EPNALAETKKKAEEEAKAEEEVAKRKYDYATLKVALAKKEVEAKELEIEKLQYEISTLEQEVATAQHQVD
NLKKLLAGADPDDGTEVIEAKLKKGEAELNAKQAELAKKQTELEKLLDSLDPEGKTQDELDKEAEEAEL
DKKADELQNKVADLEKEISNLEILLGGADXEDDTAALQNKLATKKAELEKTQKELDAALNELGPDGEE
ETPAPAPQPEQPAPAPKPEQPAPAPKPEQPAPAPKPEQPAPAPKPEQPAPKPEKPAEEPTQ
PEKPATPKTGWKQENGMWYFYNTDGSMAIGWLQNNGSWYYLNANGAMATGWVKDGDTWYYLEASGAMKA
SQWFKVSDKWYYVNSNGAMATGWLQYNGSWYYLNANGDMATGWLQYNGSWYYLNANGDMATGWAKVNGS
WYYLNANGAMATGWAKVNGSWYYLNANGSMATGWVKDGDTWYYLEASGAMKASQWFKVSDKWYYVNGLG
ALAVNTTVDGYKVNANGEWV SP093 nucleotide (SEQ ID NO:161)
TGGACAGGTGAAAGGTCATGCTACATTTGTGAAATCCATGACAACTGAAATGTACCAAGAACAACAGAA
CCATTCTCTCGCCTACAATCAACGCTTGGNTTCGCAAAATCGCATTGTAGATCCTTTTTTGGCGGAGG
ATATGAGGTCAATTACCAAGTGTCTGACGACCCTGATGCAGTCTATGGTTACTTGTCTATTCCAAGTTT
GGAAATCATGGAGCCGGTTTATTTGGGAGCAGATTATCATCATTTAGGGATGGGCTTGGCTCATGTGGA
TGGTACACCGCTGCCTCTGGATGGTACAGGGATTCGCTCAGTGATTGCTGGGCACCGTGCAGAGCCAAG
CCATGTCTTTTTCCGCCATTTGGATCAGCTAAAAGTTGGAGATGCTCTTTATTATGATAATGGCCAGGA
AATTGTAGAATATCAGATGATGGACACAGAGATTATTTACCGTCGGAATGGGAAAAATTAGAATCGGT
```

TABLE 1-continued

```
TAGCTCTAAAAATATCATGACCTTGATAACCTGCGATCCGATTCCTACCTTTAATAAACGCTTATTAGT
GAATTTTGAACGAGTCGCTGTTTATCAAAAATCAGATCCACAAACAGCTGCAGTTGCGAGGGTTGCTTT
TACGAAAGAAGGACAATCTGTATCGCGTGTTGCAACCTCTCAATGGTTG

SP093 amino acid (SEQ ID NO:162)
GQVKGHATFVKSMTTEMYQEQQNHSLAYNQRLXSQNRIVDPFLAEGYEVNYQVSDDPDAVYGYLSIPSL
EIMEPVYLGADYHHLGMGLAHVDGTPLPLDGTGIRSVLAGHRAEPSHVFFRHLDQLKVGDALYYDNGQE
IVEYQMNDTEIILPSEWEKLESVSSKNIMTLITCDPIPTFNKRLLVNFERVAVYQKSDPQTAAVARVAF
TKEGQSVSRVATSQWL SP094 nucleotide (SEQ ID NO:163)
GATTGCTCCTTTGAAGGATTTGAGAGAAACCATGTTGGAAATTGCTTCTGGTGCTCAAAATCTTCGTGC
CAAGGAAGTTGGTGCCTATGAACTGAGAGAAGTAACTCGCCAATTTAATGCTATGTGGGATCAGATTGA
TCAGTTGATGGTAGCTATTCGTAGCCAGGAAGAAACGACCCGTCAGTACCAACTTCAAGCCCTTTCGAG
CCAGATTAATCCACATTTCCTCTATAACACTTTGGACACCATCATCTGGATGGCTGAATTTCATGATAG
TCAGCGAGTGGTGCAGGTGACCAAGTCCTTGGCAACCTATTTCCGCTTGGCGCTCAATCAAGGCAAGGA
CTTGATTTGTCTCTCTGACGAAATCAATCATGTCCGCCAGTATCTCTTTATCCAGAAACAACGCTATGG
AGATAAGCTGGAATACGAAATTAATGAAAATGTTGCCTTTGATAATTTAGTCTTACCCAAGCTGGTCCT
ACAACCCCTTGTAGAAAATGCTCTTTACCATGGCATTAAGGAAAAGGAAGGTCAGGGCCATATTAAACT
TTCTGTCCAGAAACAGGATTCGGGATTGGTCATCCGTATTGAGGATGATGGCGTTGGCTTCCAAGATGC
TGGTGATAGTAGTCAAAGTCAACTCAAACGTGGGGGAGTTGGTCTTCAAAATGTCGATCAACGGCTCAA
ACTTCATTTTGGAGCCAATTACCATATGAAGATTGATTCTAGACCCCAAAAAGGGACGAAAGTTGAAAT
ATATATAAATAGAATAGAAACTAGC SP094 amino acid (SEQ ID NO:164)
IAPLKDLRETMLEIASGAQNLRAKEVGAYELREVTRQFNAMLDQIDQLMVAIRSQEETTRQYQLQALSS
QINPHFLYNTLDTIIWMAEFHDSQRVVQVTKSLATYFRLALNQGKDLICLSDEINHVRQYLFIQKQRYG
DKLEYEINENVAFDNLVLPKLVLQPLVENALYHGIKEKEGQGHIKLSVQKQDSGLVIRIEDDGVGFQDA
GDSSQSQLKRGGVGLQNVDQRLKLHFGANYHMKIDSRPQKGTKVEIYLNRIETS SP095 nucleotide (SEQ ID NO:165)
TAGGTCATATGGGACTTTTTTTCTACAACAAAATAGGCTCCATAATATCTATAAGGGATTTACCCACTA
CAAATATTATAGAGCCGAAAATTCACATCTAATATATGCAGACTACTTTGAAATGAAATTAAAAAAATT
ATTAAAGGATGACACAAAAGTTTTTGAAAAATCTACATTCAAATTTGTAGAAGGATATAAAATATACCT
GACAGAATCTAAAGAATCTCGAATTAAACAAATGGACAATGTCATAAAATATTTTGAGTTTATTGAATC
TAAAAGTATTGCTTTATATTTTCAAAAACGATTAAATGAGCTGATAGAT SP095 amino acid (SEQ ID NO:166)
RSYGTFFLQQNRLHNIYKGFTHYKYYRAENSHLIYADYFEMKLKKLLKDDTKVFEKSTFKFVEGYKIYL
TESKESGIKQMDNVIKYFEFIESKSIALYFQKRLNELID SP096 nucleotide (SEQ ID NO:167)
CAACGTTGAGAATTATTTGCGAATGTGTTTGGATAGCATTCAGAATCAGACGTATCAAAATTTTGAGTG
TTTATTAATCAATGATGGCTCTCCAGATCATTCATCCAAAATATGTGAAGAATTTGTAGAGAAAGATTC
TCGTTTCAAATATTTTGAGAAAGCAAACGGCGGTCTTTCATCAGCTCGTAACCTAGGTATTGAATGTTC
GGGGGGGGGCGTACATTACTTTTGTAGACTC SP096 amino acid (SEQ ID NO:168)
NVENYLRMCLDSIQNQTYQNFECLLINDGSPDHSSKICEEFVEKDSRFKYFEKANGGLSSAPNLGIECS
GGGVHYFCRL SP097 nucleotide (SEQ ID NO:169)
CTACTATCAATCAAGTTCTTCAGCCATTGAGGCCACCATTGAGGGCAACAGCCAAACGACCATCAGCCA
GACTAGCCACTTTATTCAGTCTTATATCAAAAAACTAGAAACCACCTCGACTGGTTTGACCCAGCAGAC
GGATGTTCTGGCCTATGCTGAGAATCCCAGTCAAGACAAGGTCGAGGGAATCCGAGATTTGTTTTTGAC
CATCTTGAAGTCAGATAAGGACTTGAAAACTGTTGTGCTGGTGACCAAATCTGGTCAGGTCATTTCTAC
AGATGACAGTGTGCAGATGAAAACTTCCTCTGATATGATGGCTGAGGATTGGTACCAAAAGGCCATTCA
TCAGGGAGCTATGCCTGTTTTGACTCCAGCTCGTAAATCAGATAGTCAGTGGGTCATTTCTGTCACTCA
AGAACTTGTTGATGCAAAGGGAGCCAATCTTGGTGTGCTTCGTTTGGATATTTCTTATGAAACTCTGGA
AGCCTATCTCAATCAACTCCAGTTGGGGCAGCAGGGCTGGGCCTTCATTATCAATGAAAACCATGAATT
TGTCTACCATCCTCAACACACAGTTTATAGTTCGTCTAGCAAAATGGAGGCTATGAAACCCTACATCGA
TACAGGTCAGGGTTATACTCCTGGTCACAAATCCTACGTCAGTCAAGAGAAGATTGCAGGAACTGATTG
GACGGTGCTTGGCGTGTCATCATTGGAAAAGTTAGACCAGGTTCGGAGTCAG SP097 amino acid (SEQ ID NO:170)
YYQSSSSAIEATIEGNSQTTISQTSHFIQSYIKKLETTSTGLTQQTDVLAYAENPSQDKVEGIRDLFLT
ILKSDKDLKTVVLVTKSGQVISTDDSVQMKTSSDMMAEDWYQKAIHQGAMPVLTPARKSDSQWVISVTQ
ELVDAKGANLGVLRLDISYETLEAYLNQLQLGQQGFAFIINENEHEFYYHPQHTVYSSSSKMEAMKPYID
TGQYTPGHKSYVSQEKIAGTDWTVLGVSSLEKLDQVRSQ SP098 nucleotide (SEQ ID NO:171)
GACAAAAACATTAAAACGTCCTGAGGTTTTATCACCTGCAGGGACTTTAGAGAAGCTAAAGGTAGCTGT
TCAGTATGGAGCAGATGCTGTCTTTATCGGTGGTCAGGCCTATGGTCTTCGTAGCCGTGCGGGAAACTT
TACTTTCGAACAGATGAAGAAGGCGTGCAGTTTGCGGCCAAGTATGGTGCCAAGGTCTATGTAGCGGC
TAATATGGTTATGCACGAAGGAAATGAAGCTGGTGCTGGTGAGTGGTTCCGTAAACTGCGTGATATCGG
GATTGCAGCAGTTATCGTATCTGACCCAGCCTTGATTATGATTGCAGTGACTGAAGCACCAGGCCTTGA
AATCCACCTTTCTACCCAAGCCAGTGCCACTAACTATGAAACCCTTGAGTTCTGGAAAGAGCTAGGCTT
GACTCGTGTCGTTTAGCGCGTGAGGTTTCAATGGAAGAATTAGCTGAGATCCGCAAACGTACAGATGT
TGAAATTGAAGCCTTTGTCCATGGAGCTATGTGTATTTCATACTCTGGACGTTGTACTCTTTCAAACCA
```

TABLE 1-continued

```
CATGAGTATGCGTGATGCCAACCGTGGTGGATGTTCTCAGTCATGCCCTTGGAAATACGACCTTTACGA
TATGCCATTTGGGAAAGAACGTAAGAGTTTGCAGGGTGAGATTCCAGAAGAATTTTCAATGTCAGCCGT
TGACATGTCTATGATTGACCANATTCCAGATATGATTGAAAATGGTGTGGACAGTCTAAAAATCGAAGG
ACGTATGNAGTCTATTCACTANGTATCAACAGTAACCAACTGCTACAAGGCGGCTGTGGATGCCTATCT
TGAAAGTCCTGGAAAGTTTGAAGCTATCAAACAAGACTTGGTGGACGAGATGTGGAAGGTTGCCCAACG
TGAACTGGCTACAGGATTTTACTATGGTACACCATCTGAAAATGAGCAGTTGTTTGGTGCTCGTCGTAA
AATCCCTGAGTACAAGTTTGTCGCTGAAGTGGTTTCTTATGATGATGCGGCACAAACAGCAACTATTCG
TCAACGAAACGTCATTAACGAAGGGGACCAAGTTGAGTTTTATGGTCCAGGTTTCCGTCATTTTGAAAC
CTATATTGAAGATTTGCATGATGCTAAAGGCAATAAAATCGACCGCGCTCCAAATCCAATGGAACTATT
GACTATTAAAGTCCCACAACCTGTTCAATCAGGAGACATGGTTCGAGCTCTTAAAGAGGGGCTTATCAA
TCTTTATAAGGAAGATGGAACCAGGGTCACAGTTCGTGCT

SP098 amino acid (SEQ ID NO:172)
TKTLKRPEVLSPAGTLEKLKVAVQYGADAVFIGGQAYGLRSRAGNFTFEQMEEGVQFAAKYGAKVYVAA
NMVMHEGNEAGAGEWFRKLRDIGIAAVIVSDPALIMIAVTEAPGLEIHLSTQASATNYETLEFWKELGL
TRVVLAREVSMEELAEIRKRTDVEIEAFVHGAMCISYSGRCTLSNHMSMRDANRGGCSQSCRWKYDLYD
MPFGKERKSLQGEIPEEFSMSAVDMSMIDXIPDMIENGVDSLKIEGRMXSIHXVSTVTNCYKAAVDAYL
ESPEKFEAIKQDLVDEMWKVAQRELATGFYYGTPSENEQLFGARRKIPEYKFVAEVVSYDDAAQTATIR
QRNVINEGDQVEFYGPGFRHFETYIEDLHDAKGNKIDRAPNPMELLTIKVPQPVQSGDMVRALKEGLIN
LYKEDGTSVTVRA SP099 nucleotide (SEQ ID NO:173)
TTCTCAGGAGACCTTTAAAAATATCACCAATAGCTTCTCCATGCAAATCAATCGTCGCGTCAACCAAGG
AACGCCTCGTGGTGCTGGGAATATCAAGGGTGAAGACATCAAAAAAATCACCGAAAACAAGGCCATTGA
GTCTTATGTCAAACGTATCAACGCTATCGGAGATTTGACTGGATATGACCTGATTGAAACGCCAGAAAC
CAAGAAGAATCTCACTGCTGATCGTGCCAAGCGTTTTGGAAGTAGCTTGATGATTACAGGTGTCAATGA
CTCCTCTAAAGAAGACAAGTTTCTCTCTGGTTCTTATAAACTAGTCGAAGGAGAGCACTTAACCAACGA
CGACAAGGATAAAATCCTCTTGCACAAGGACTTGGCAGCCAAACAGGGCTGGAAAGTAGGGGACAAGGT
TAAACTGGACTCTAATATCTACGATGCAGATAATGAAAAAGGAGCCAAGGAAACAGTTGAAGTGACAAT
CAAGGCACTCTTTGATGGTCATAATAAGTCAGCAGTAACCTACTCACAAGAACTTTACGAAAACACAGC
TATTACAGACATTCACACTGCTGCAAAACTTTATGGATACACAGAAGACACAGCCATTTATGGGGACGC
AACCTTCTTTGTAACAGCAGACAAGAACTTGGATGATGTTATGAAAGAGTTGAATGGCATCAGTGGTAT
CAACTGGAAGAGGTACACACTCGTCAAGAGCTCCTCTAACTACCCAGCTCTTGAGCAATCTATCTCTGG
TATGTACAAGATGGCCAAC SP099 amino acid (SEQ ID NO:174)
SQETFKNITNSFSMQINRRVNQGTPRGAGNIKGEDIKKITENKAIESYVKRINAIGDLTGYDLIETPET
KKNLTADRAKRFGSSLMITGVNDSSKEDKFVSGSYKLVEGEHLTNDDKDKILLHKDLAAKHGWKVGDKV
KLDSNIYDADNEKGAKETVEVTIKGLFDGHNKSAVTYSQELYENTAITDIHTAAKLYGYTEDTAIYGDA
TFFVTADKNLDDVMKELNGISGINWKSYTLVKSSSNYPALEQSISGMYKMAN SP100 nucleotide (SEQ ID NO:175)
AGTAAATGCGCAATCAAATTCATTAATATTAATAGATGAACCTGAAATCTCACTTGATCCGAGTGCAAT
CTATAAATTTAAAGAGTTTTTACTTCAAGAGTGTTTAAATAAAAAACATCAAATTATTATCACTACACA
TTCTCACAACTTATAAAAGATTTTCCTAGAGAAGCCGTGAAACTTTTAGTGAAAAACGCAAAAGGT
AGATGTTATTGAAAATATTGATTATCAGGATGCATTTTTTGAATTAGGTGATGTGTATCATTCTAGGAA
GATGATTTATGTTGAAGATAGACTAGCTAAATATATTCTAGAGTTTGTTATCACTCATTCAGGTAGTGA
GAATCTTAAACAGAATTTAGTAGTGAGATATATTCCTGGTGGAGCAAATCAAATAATTTGTAATAATAT
TTTAAACTCATCGTATTTAGATTCCGATAAGCATTATTTTTGCGTTTGATGGAGATCAAAACACTAATGT
TAGTGAATCAAATAATTTAATGAACTATCTTGAAAATGGTGTTGTTATATCGATAAAATTCCTGAATC
AGATAATAAAAATCTTGATGATATTATAAAATTGATAAGNGGGATGTCCAATTAAATTTAATGTTTCAGG
TAATAAAGGGCAAAAAAATAATATTGAATTAATTGCGAAACAAAGAAGCTTTATAGATTATTGGGCTAA
ATAC SP100 amino acid (SEQ ID NO:176)
VNAQSNSLILIDEPEISLHPSAIYKFKEFLLQECLNKKHQIIITTHSTQLIKDFPREAVKLLVKNGEKV
DVIENIDYQDAFFELGDVYHSRKMIYVEDRLAKYILEFVITHSGSENLKQNLVVRYIPGGANQIICNNI
LNSSYLDSDNHYFWLDGDQNTNVSESNNLMNYLENGVVISDKIPESDNKMLDDIIKLIXGCPIKFNVSG
NKGQKNNIELIAKQRSFIDYWAKY SP101 nucleotide (SEQ ID NO:177)
TTACCGCGTTCATCAAGATGTCAAACAAGTCATGACCTATCAACCCATGGTGCGAGAAATATTGAGTGA
ACAAGACACCCCAGCAAACGAAGAGCTTGTGCTTGCTATGATTTATACTGAAACAAAAGGAAAAGAAGG
CGATGTTATGCAGTCTAGTGAGTCTGCAAGTGGTTCCACCAACACCATCAATGATAATGCCTCTAGCAT
TCGGCAAGGCATTCAAACTCTGACAGGCAATCTCTATCTGGCGCAGAAGAAGGGGTAGATATCTGGAC
AGCTGTTGAAGCCTATAATTTTGGACCTGGCTATATCGATTTTATCGCCCAAAATGGCAAGGAAAATAC
CCTGGCTCTAGCCAAACAGTACTCTCGTGAGACTGTTGCCCCCTTGCTTGGTAATAGGACTGGAAAGAC
TTATAGTTATATTCACCCCATTTCCATTTTTCACGGTGCTGAACTCTATGTAAATGGAGGAAACTATTA
TTATTCTAGACAGGTACGACTTAACCTTTACATCATCAAATGTTTCACTCTCTTTTCAACATCTGGC SP101 amino acid (SEQ ID NO:178)
YRVHQDVKQVMTYQPMVREILSEQDTPANEELVLAMIYTETKGKEGDVMQSSESASGSTNTINDNASSI
RQGIQTLTGNLYLAQKKGVDIWTAVQAYNFGPAYIDFIAQNGKENTLALAKQYSRETVAPLLGNRTGKT
YSYIHPISIFHGAELYVNGGNYYYSRQVRLNLYIIKCFTLFSTSG SP102 nucleotide (SEQ ID NO:179)
GTGGATGGGCTTTAACTATCTTCGTATTCGCCGTGCGGCTAAAATTGTGGACAATGAGGAGTTTGAAGC
CTTGATTCGTACGGGTCAATTGATTGATTTGCGCGACCCAGCAGAATTCCACAGAAAACATATCCTTGG
TGCACGCAATATTCCTTCAAGTCAGTTGAAAACTAGTCTTGCAGCCCTTCGTAAAGATAAACCTGTCCT
```

TABLE 1-continued

TCTCTACGAAAACCAACGTGCGCAACGAGTTACAAATGCAGCTCTTTACTTGAAAAAACAAGGTTTTTC
TGAGATTTATATCCTTTCTTATGGCTTGGATTCTTGGAAAGGGAAAGTGAAGACTAGC

SP102 amino acid (SEQ ID NO:180)
WMGFNYLRIRRAAKIVDNEEFEALIRTGQLIDLRDPAEFHRKHILGARNIPSSQLKTSLAALRKDKPVL
LYENQRAQRVTNAALYLKKQGFSEIYILSYGLDSWKGKVKTS SP103 nucleotide (SEQ ID NO:181)
ACTAAACCAGCATCGTTCGCAGGAAAATAAGGACAATAATCGTGTCTCTTATGTGGATGGCAGCCAGTC
AACTCAGAAAAGTGAAAACTTGACACCAGACCAGGTTAGCCAGAAAGAAGGAATTCAGGCTGAGCAAAT
TGTAATCAAAATTACAGATCAGGGCTATGTAACGTCACACGGTGACCACTATCATTACTATAATGGGAA
AGTTCCTTATGATGCCCTCTTTAGTGAAGAACTCTTGATGAAGGATCCAAACTATCAACTTAAAGACGC
TGATATTGTCAATGAAGTCAAGGGTGGTTATATCATCAAGGTCGATGGAAAATATTATGTCTACCTGAA
AGATGCAGCTCATGCTGATAATGTTCGAACTAAAGATGAAATCAATCGTCAAAAACAAGAACATGTCAA
AGATAATGAGAAGGTTAACTCTAATGTTGCTGTAGCAAGGTCTCAGGGACGATATACGACAAATGATGG
TTATGTCTTTAATCCAGCTGATATTATCGAAGATACGGGTAATGCTTTATATCGTTCCTCATGGAGGTCA
CTATCACTACATTCCCAAAAGCGATTTATCTGCTAGTGAATTAGCAGCAGCTAAAGCACATCTGGCTGG
AAAAAATATGCAACCGAGTCAGTTAAGCTATTCTTCAACAGCTAGTGACAATAACACGCAATCTGTAGC
AAAAAGGATCAACTAGCAAGCCAGCAAATAAATCTGAAAATCTCCAGAGTCTTTTGAAGGAACTCTATGA
TTCACCTAGCGCCCAACGTTACAGTGAATCAGATGGCCTGGTCTTTGACCCTGCTAAGATTATCAGTCG
TACACCAAATGGAGTTGCGATTCCGCATGGCGACCATTACCACTTTATTCCTTACAGCAAGCTTTCTGC
CTTAGAAGAAAAGATTGCCAGAATGGTGCCTATCAGTGGAACTGGTTCTACAGTTTCTACAAATGCAAA
ACCTAATGAAGTAGTGTCTAGTCTAGGCAGTCTTTCAAGCAATCCTTCTTCTTTAACGACAAGTAAGGA
GCTCTCTTCAGCATCTGATGGTTATATTTTTAATCCAAAAGATATCGTTGAAGAAACGGCTACAGCTTA
TATTGTAAGACATGGTGATCATTTCCATTACATTCCAAAATCAAATCAAATTGGGCAACCGACTCTTCC
AAACAATACTCTAGCAACACCTTCTCCATCTCTTCCAATCAATCCAGGAACTTCACATGAGAAACATGA
AGAAGATGGATACGGATTTGATGCTAATCGTATTATCGCTGAAGATGAATCAGGTTTTGTCATGAGTCA
CGGAGACCACAATCATTATTTCTTCAAGAAG SP103 amino acid (SEQ ID NO:182)
LNQHRSQEKKDNNRVSYVDGSQSSQKSENLTPDQVSQKEGIQAEQIVIKITDQGYVTSHGDHYHYYNGK
VPYDALFSEELLMKDPNYQLKDADIVNEVKGGYIIKVDGKYYVLKDAAHADNVRTKDEINRQKQEHVK
DNEKVNSNVAVARSQGRYTTNDGYVFNPADIIEDTGNAYIVPHGGHYHYIPKSDLSASELAAAKAHLAG
KNMQPSQLSYSSTASDNNTQSVAKGSTSKPANKSENLQSLLKELYDSPSAQRYSESDGLVFDPAKIISR
TPNGVAIPHGDHYHFIPYSKLSALEEKIARMVPISGTGSTVSTNAKPNEVVSSLGSLSSNPSSLTTSKE
LSSASDGYIFNPKDIVEETATAYIVRHGDHFHYIPKSNQIGQPTLPNNSLATPSPSLPINPGTSHEKHE
EDGYGFDANRIIAEDESGFVMSHGDHNHYFFKK SP105 nucleotide (SEQ ID NO:183)
TGACTACCTTGAAATCCCACTTTACAGCTATCTTGGTGGATTCAACACTAAAGTTCTTCCAACTCCAAT
GATGAACATCATCAACGGTGGTTCTCACTCTGACGCTCCAATCGCTTTCCAAGAGTTCATGATCTTGCC
AGTTGGTGCGCCAACATTTAAAGAAGCCCTTCGTTACGGTGCTGAAATCTTCCACGCTCTTAAGAAAAT
CCTTAAATCACGTGGTTTGGAAACTGCCGTAGGTGACGAAGGTGGATTCGCTCCTCGTTTCGAAGGAAC
TGAAGATGGTGTTGAAACTATCCTTGCTGCGATTGAAGCTGCTGGATATGTACCAGGTAAAGACGTATT
TATCGGATTTGACTGTGCTTCATCAGAATTCTACGATAAAGAACGTAAAGTTTACGACTACACTAAATT
TGAAGGTGAAGGTGCTGCTGTTCGTACATCTGCAGAACAAATCGACTACCTTGAAGAATTGGTTAACAA
ATACCCAATCATCACTATTGAAGATGGTATGGATGAAAACGACTGGGATGGTTGGAAAGCTCTTACTGA
ACGTCTTGGTAAGAAAGTACAACTTGTTGGTGACGACTTCTTCGTAACAAACACTGACTACCTTGCACG
TGGTATCCAAGAAGGTGCTGCTAACTCAATCCTTATCAAAGTTAACCAAATCGGTACTCTTACTGAAAC
TTTTGAAGCTATCGAAATGGCTAAAGAAGCTGGTTACACTGCTGTTGTATCACACCGTTCAGGTGAAAC
TGAAGATTCAACAATCGCTGATATTGCAGTTGCAACTAACGCAGGACAAATCAAGACTGGTTCACTTTC
ACGTACAGACCGCATCGCTAAATACAACCAATTGCTTCGTATCGAAGACCAACTTGGTGAAGTAGCTGA
ATATCGTGGATTGAAATCATTCTACAACCTTAAAAA SP105 amino acid (SEQ ID NO:184)
DYLEIPLYSYLGGFNTKVLPTPMMNIINGGSHSDAPIAFQEFMILPVGAPTFKEALRYGAEIFHALKKI
LKSRGLETAVGDEGGFAPRFEGTEDGVETILAAIEAAGYVPGKDVFIGFDCASSEFYDKERKVYDYTKF
EGEGAAVRTSAEQIDYLEELVNKYPIITIEDGMDENDWDGWKALTERLGKKVQLVGDDFFVTNTDYLAR
GIQEGAANSILIKVNQIGTLTETFEAIEMAKEAGYTAVVSHRSGETEDSTIADIAVATNAGQIKTGSLS
RTDRIAKYNQLLRIEDQLGEVAEYRGLKSFYNLKK SP106 nucleotide (SEQ ID NO:185)
TCGTATCTTTTTTTGGAGCAATGTTCGCGTAGAAGGACATTCCATGGATCCGACCCTAGCGGATGGCGA
AATTCTCTTCGTTGTAAAACACCTTCCTATTGACCGTTTTGATATCGTGGTGGCCCATGAGGAAGATGG
CAATAAGGACATCGTCAAGCGCGTGATTGGAATGCCTGGCGACACCATTCGTTACGAAAATGATAAACT
CTACATCAATGACAAAGAAACGGACGAGCCTTATCTAGCAGACTATATCAAACGCTTCAAGGATGACAA
ACTCCAAAGCACTTACTCAGGCAAGGGCTTTGAAGGAAATAAAGGAACTTTCTTTAGAAGTATCGCTCA
AAAAGCTCAAGCCTTCACAGTTGATGTCAACTACAACACCAACTTTAGCTTTACTGTTCCAGAAGGAGA
ATACCTTCTCCTCGGAGATGACCGCTTGGTTTCGAGCGACAGCCGCCACGTAGGTACCTTCAAAGCAAA
AGATATCACAGGGGAAGCTAAATTCCGCTTATGGCCAATCACCCGTATCGGAACATTT SP106 amino acid (SEQ ID NO:186)
RIFFWSNVRVEGHSMDPTLADGEILFVVKHLPIDRFDIVVAHEEDGNKDIVKRVIGMPGDTIRYENDKL
YINDKETDEPYLADYIKRFKDDKLQSTYSGKGFEGNKGTFFRSIAQKAQAFTVDVNYNTNFSFTVPEGE
YLLLGDDRLVSSDSRHVGTFKAKDITGEAKFRLWPITRIGTF SP107 nucleotide (SEQ ID NO:187)
GGACTCTCTCAAAGATGTGAAAGCAAATGCTAGCGACAGCAAGCCTGCACAGGACAAGAAGGATGCAAA
ACAAGGAACGGAAGATAGTAAGGATTCAGATAAGATGACTGAAACAAACTCAGTTCCGGCAGGAGTGAT TABLE 1-continued TGTGGTCAGTCTACTTGCCCTCCTAGGCGTGATTGCCTTCTGGCTGATTCGCCGTAAGAAAGAGTCAGA
AATCCAGCAATTAAGCACGGGATTGATCAAGGTTCTAGGACAGCTAGATGCAGAAAAAGCGGATAAAAA
AGTCCTTGCCAAAGCCCAAAACCTTCTCCAAGAAACCCTTGATTTCGTGAAAGAAGAAAATGGCTCAGC
AGAGACAGAAACTAAACTAGTAGAGGAGCTTAAAGCAATCCTTGACAAACTCAAG SP107 amino acid (SEQ ID NO:188)
DSLKDVKANASDSKPAQDKKDAKQGTEDSKDSDKMTETNSVPAGVIVVSLLALLGVIAFWLIRRKKESE
IQQLSTELIKVLGQLDAEKADKKVLAKAQNLLQETLDFVKEENGSAETETKLVEELKAILDKLK SP108 nucleotide (SEQ ID NO:189)
CAAGAAATCCTATCATCTCTTCCAGAAGCAAACAGAGACGAGGGGAATTCAGACTCAGTTGATTGAAGA
ATCGCTTAGTCAGCAGACTATAATCCAGTCCTTCAATGCTCAAACAGAATTTATCCAAAGATTGCGTGA
GGCTCATGACAACTACTCAGGCTATTCTCAGTCAGCCATCTTTTATTCTTCAACGGTCAATCCTTCGAC
TCGCTTTGTAAATGCACTCATTTATGCCCTTTTAGCTGGAGTAGGAGCTTATCGTATCATGATGGGTTC
AGCCTTGACCGTCGGTCGTTTAGTGACTTTTTTGAACTATGTTCAGCAATACACCAAGCCCTTTAACGA
TATTTCTTCAGTGCTAGCTGAGTTGCAAAGTGCTCTGGCTTGCGTAGAGCGTATCTATGAGTCTTAGA
TAGCCCTGAAGTGGCTGAAACAGGTAAGGAAGTCTTGACGACCAGTGACCAAGTTAAGGGAGCTATTTC
CTTTAAACATGTCTCTTTTGGCTACCATCCTGAAAAAATTTTGATTAAGGACTTGTCTATCGATATTCC
AGCTGGTAGTAAGGTAGCCATCGTTGGTCCGACAGCTGCTGGAAAATCAACTCTTATCAATCTCCTTAT
GCGTTTTTATCCCATTAGCTCGGGAGATATCTTGCTGGATGGCAATCCATTTATGATTATACACGAGT
ATCATTGAGACAGCAGTTTGGTATGGTGCTTCAAGAAACCTGGCTCACACAAGGGACCATTCATGATAA
TATTGCCTTTGGCAATCCTGAAGCCAGTCGAGAGCAAGTAATTGCTGCTGCCAAAGCAGCTAATGCAGA
CTTTTTTCATCCAACAGTTGCCACAGGGATACGATACCAAGTTGGAAAATGCTGGAGAATCTCTCTCTGT
CGGCCAAGCTCAGCTCTTGACCATAGCCCGAGTCTTTCTGGCTATTCCAAAGATTCTTATCTTAGACGA
GGCAACTTCTTCCATTGATACACGGACAGAAGTGCTGGTACAGGATGCCTTTGCAAAACTCATGAAGGG
CCCGCACAAGTTTCATCATTGCTCACCGTTTGTCAACCATTCAGGATGCGGATTTAATTCTTGTCTTAGT
AGATGGTGATATTGTTGAATATGGTAACCATCCACAACTCATGGATAGAAAGGGTAAGTATTACCAAAT
GCAAAAAGCTGCGGCTTTTAGTTCTGA
A SP108 amino acid (SEQ ID NO:190)
KKSYHLFQKQTETRGIQTQLIEESLSQQTIIQSFNAQTEFIQRLREAHDNYSGYSQSAIFYSSTVNPST
RFVNALIYALLAGVGAYRIMMGSALTVGRLVTFLNYVQQYTKPFNDISSVLAELQSALACVERIYGVLD
SPEVAETGKEVLTTSDQVKGAISFKHVSFGYHPEKILIKDLSIDIPAGSKVAIVGPTGAGKSTLINLLM
RFYPISSGDILLDGQSIYDYTRVSLRQQFGMVLQETWLTQGTIHDNIAFGNPEASREQVIAAAKAANAD
FFIQQLPQGYDTKLENAGESLSVGQAQLLTIARVFLAIPKILILDEATSSIDTRTEVLVQDAFAKLMKG
RTSFIIAHRLSTIQDADLILVLVDGDIVEYGNHQELMDRKGKYYQMQKAAAFSSE SP109 nucleotide (SEQ ID NO:191)
ACGAAATGCAGGGCAGACAGATGCCTCGCAAATTGAAAAGGCGGCAGTTAGCCAAGGAGGAAAAGCAGT
GAAAAAAACAGAAATTAGTAAAGACGCAGACTTGCACGAAATTTATCTAGCTGGAGGTTGTTTCTGGGG
AGTGGAGGAATATTTCTCACGTGTTCCCGGGGTGACGGATGCCGTTTCAGGCTATGCAAATGGTAGAGG
AGAAACAACCAAGTACCAATTGATTAACCCAAACAGGTCATGCAGAAACCGTCCATGTCACCTATGATGC
CAAGCAAATTTCTCTCAAGGAAATCCTGCTTCACTATTTCCGCATTATCAATCCAACCAGCAAAAATAA
ACAAGGAAATGATGTGGGGACCCAGTACCGTACTGGTGTTATTACACAGATGACAAGGATTTGGAAGT
GATTAACCAAGTCTTTGATGAGGTGGCTAAGAAATACGATCAACCTCTAGCAGTTGAAAAGGAAAACTT
GAAGAATTTTGTGGTGGCTGAGGATTACCATCAAGACTATCTCAAGAAAAATCCAAATGGCTACTGCCA
TATCAATGTTAATCAGGCGGCCTATCCTGTCATTGATGCCAGCAAATATCCAAAACCAAGTGATGAGGA
ATTGAAAAAAGACCCTGTCACCTGAGGAGTATGCAGTTACCCAGGAAAATCAAACAGAACGAGCTTTCTC
AAACCGTTACTGGGATAAATTTGAATCCGGTATCTATGTGGATATAGCAACTGGGGAACCTCTCTTTTC
ATCAAAAGACAAATTTGAGTCTGGTTGTGGCTGGCCTAGTTTTACCCAACCCATCAGTCCAGATGTTGT
CACCTACAAGGAAGATAAGTCCTACAATATGACGCGTATGCAAGTGCGGAGCCGAGTAGGAGATTCTCA
CCTTGGGCATGTCTTTACGGATGGTCCACAGGACAAGGGCGGCTTACGTTACTGTATCAATAGCCTCTC
TATCCGCTTTATTCCCAAAGACCAAATGGAAGAAAAAGGCTACGCTTATTTACTAGATTATGTTGAT SP109 amino acid (SEQ ID NO:192)
RNAGQTDASQIEKAAVSQGGKAVKKTEISKDADLHEIYLAGGCFWGVEEYFSRVPGVTDAVSGYANGRG
ETTKYELINQTGHAETVHVTYDAKQISLKEILLHYFRIINPTSKNKQGNDVGTQYRTGVYYTDDKDLEV
INQVFDEVAKKYDQPLAVEKENLKNFVVAKDYHQDYLKKNPNGYCHINVNQAAYPVIDASKYPKPSDEE
LKKTLSPEEYAVTQENQTERAFSNRYWDKFESGIYVDIATGEPLFSSKDKFESGCGWPSFTQPISPDVV
TYKEDKSYNMTRMEVRSRVGDSHLGHVFTDGPQDKGGLRYCINSLSIRFIPKDQMEEKGYAYLLDYVD SP110 nucleotide (SEQ ID NO:193)
TGTATAGTTTTTAGCGCTTGTTCTTCTAATTCTGNTAAAAATGGAGAAAATACTTCTAAAGAGCATGCG
CCTGATAAAATAGTTTTAGATGATGGTTTCGGTCAAACTATATTAGATAAAAAACCTGAAAGAGTTGCA
ACTATTGCTTGGGGAAATCATGATGTAGCATTAGCTTTAGGAATAGTTCCTGTTGGATTTTCAAAAGCA
AATTACGGTGTAAGTGCTGATAAAGGAGTTTTACCATGGACAGAAGAAAAAATCAAAGAACTAAATGGT
AAAGCTAACCTATTTGAGGATTTGGATGGACTTAACTTTGAAGCAATATCAAATTCTAAACCAGATGTT
ATCTTAGCAGGTTATTCTGGTATAACTAAAGAAGATTATGACACTCTATCA SP110 amino acid (SEQ ID NO:194)
CIVFSACSSNSXKNEENTSKEHAPDKIVLDHAFGQTILDKKPERVATIAWGNHDVALALGIVPVGFSKA
NYGVSADKGVLPWTEEKIKELNGKANLFDDLDGLNFEAISNSKPDVILAGYSGITKEDYDTLS SP111 nucleotide (SEQ ID NO:195)
GTGTGTCGAGCATATTCTGAAGCAAACCTATCAAAATATAGAAATTATTTTAGTTGATGACGGTTCTAC
GGATAATTCTGGGGAAATTTGTGATGCTTTTATGATGCAAGATAATCGTGTGCGAGTATTGCATCAAGA
AAATAAGGGGGGGCAGCACAAGCTAAAAATATGGGATTAGTGTAGCTAAGGGAGAGTACATCACGAT
TGTTGATTCAGATGATATCGTAAAAGAAAATATGATTGAAACTCTTTATCAGCAAGTCCAAGAAAGGA TABLE 1-continued TGCAGATGTTGTTATAGGGAATTACTATAATTATGACGAAAGTGACGGGAATTTTTATTTTTATGTAAC
AGGGCAAGATTTTTGCGTCGAAGAATTAGCTATACAAGAAATTATGAACCGTCAAGCAGGAGATTGGAA
ATTCAATAGCTCGGCCTTTATATTGCCGACATTTAAGTTGATTAAAAAAGAATTATTCAATGAAGTTCA
CTTTTCAAATGGTCGCCGCTTTGATGATGAAGCAACTATGCATCGCTTTTATCTTTTAGCCTCTAAAAT
CGTCTTTATAAACGATAATCTCTATCTGTATAGAAGACGTTCAGGAAGCATCATGAGAACGGAATTTGA
TCTTTCCTGGGCAAGAGATATTGTTGAAGTGTTTTCTAAGAAAATATCGGATTGTGTCTTGGCTGGTTT
GGATGTCTCCGTTCTGCGTATTCGATTTGTCAATCTTTTAAAAGATTATAAGCAAACTTTAGAATACCA
TCAATTAACAGATACTGAGGAATATAAAGATATTTGTTTCAGATTAAAGTTGTTTTTTGATGCAGAACA
AAGAAATGGTAAAAGT SP111 amino acid (SEQ ID NO:196)
CVEHILKQTYQNIEIILVDDGSTDNSGEICDAFMMQDNRVRVLHQENKGGAAQAKNMGISVAKGEYITI
VDSDDIVKENMIETLYQQVQEKDADVVIGNYYNYDESDGNFYFYVTGQDFCVEELAIQEIMNRQAGDWK
FNSSAFILPTFKLIKKELFNEVHFSNGRRFDDEATMHRFYLLASKIVFINDNLYLYRRSGSIMRTEFD
LSWARDIVEVFSKKISDCVLAGLDVSVLRIRFVNLLKDYKQTLEYHQLTDTEEYKDICFRLKLFFDAEQ
RNGKS SP112 nucleotide (SEQ ID NO:197)
GTGTTTGGATAGCATTCAGAATCAGACGTATCAAAATTTTGAGTGTTTATTAATCAATGATGGCTCTCC
AGATCATTCATCCAAAATATGTGAAGAATTTGTAGAGAAAGATTCTCGTTTCAAATATTTTGAGAAAGC
AAACGGCGGTCTTTCATCAGCTCGTAACCTAGGTATTGAATGTTCGGGGGGGCGTACATTACTTTTGT
AGACTCTGATGATTGGTTGGAACATGATGCTTTAGACGGATTATATGGTGCTTTGAAAAAGGAAAACGC
AGATATTAGTATCGGGCGTTATAATTCTTATGATGAAACACGCTATGTGTATATGACTTATGTTACGGA
TCCAGATGATTCTCTAGAAGTGATAGAAGGTAAAGCAATTATGGATAGGGAAGGTGTCGAAGAAGTCAG
AAATGGGAACTGGACTGTAGCTGTCTTGAAGTTATTCAAGAGAGAGTTACTACAAGATTTACCATTTCC
TATAGGAAAAATTGCAGAGGATACTTACTGGACATGAAGGTACTTCTAAGAGCTTCGAGGATAGTCTA
TTTGAATCGTTCTGTTTACTGGTACCGTGTTGGTTTATCTGATACTTTATCGAATACATGGAGTGAAAA
GCGTATGTATGATGAAATTGGGCTAGGGAAGAAAAGATAGCTATTTTAGCAAGTTCAGACTATGACTT
GACCAATCATATTTTGATTTATAAAAATAGATTACAAAGAGTGATAGCAAAATTAGAAGAACAAAATAT
GCAGTTCACAGAGATTTACAGAAGAATGATGGAAAAATTGTCTTTACTTCCG SP112 amino acid (SEQ ID NO:198)
CLDSIQNQTYQNFECLLINDGSPDHSSKICEEFVEKDSRFKYFEKANGGLSSARNLGIECSGGAYITFV
DSDDWLEHDALDRLYGALKKENADISIGRYNSYDETRYVYMTYVTDPDDSLEVIEGKAIMDREGVEEVR
NGNWTVAVLKLFKRELLQDLPFPIGKIAEDTYWTWKVLLRASRIVYLNRCVYWYRVGLSDTLSNTWSEK
RMYDEIGAREEKIAILASSDYDLTNHILIYKNRLQRVIAKLEEQNMQFTEIYRRMMEKLSLLP SP113 nucleotide (SEQ ID NO:199)
GTGCCTAGATAGTATTATTACTCAAACATATAAAAATATTGAGATTGTTGTCGTTAATGATGGTTCTAC
GGATGCTTCAGGTGAAATTTGTAAAGAATTTTCAGAAATGGATCACCGAATTCTCTATATAGAACAAGA
AAATGCTGGTCTTTCTGCCGCACGAAACACCGGTCTGAATAATATGTCCGGAAATTATGTGACCTTTGT
GGACTCGGATGATTGGATTGAGCAAGATTATGTAGAAACTCTATATAAAAAAATAGTAGAGTATCAGGC
TGATATTGCAGTTGGTAATTATTAATTCTTTCAACGAAAGTGAAGGAATGTTCTACTTTCATATATTGGG
AGACTCCTATTATGAGAAAGTATATGATAATGTTTCTATCTTTGAGAACTTGTATGAAACTCAAGAAAT
GAAGAGTTTTGCTTTGATATCTGCTTGGGGTAAACTCTATAAGGCAAGATTTGTTTGAGCAGTTGCGCTT
TGACATAGGTAAATTAGGAGAAGATGGTTACCTCAATCAAAAGGTATATTTATTATCAGAAAAGGTAAT
TTATTTAAATAAAAGTCTTTATGCTTATCGGATTAGAAAAGGTAGTTTATCAAGAGTTTGGACAGAAAA
GTGGATGCACGCTTTAGTTGATGCTATGTCTGAACGTATTACGCTACTAGCTAATATGGGTTATCCTCT
AGAGAAACACTTGGGAGTTTATCGTCAGATGTTGGAAGTCAGTCTCGCCAACGGTCAAGCTAGTGGTTT
ATCTGACACAGCAACGTATAAAGAGTTTGAAATGAAACAAAGGCTTTTAAATCAGCTATCGAGACAAGA
GGAAAGTGAAAAGAAAGCCATTGTCCTCGCAGCAAACTATGGCTATGTAGACCAAGTTTAACGACAAT
CAAGTCTATTTGTTATCATAATCGTTCGATTCGTTTTTATCTGATTGATAGCGATTTTCCAAATGAATC
GATTAAGCAATTAAATAAGCGCTTAGAGAAGTTTGACTCAGAAATTATTAATTGTCGGGTAACTTCTGA
GCAAATTTCATGTTATAAATCGGATATTAGTTACACAGTCTTTTTTACGCTATTTCATAGCTGATTTCGT
GCAAGAAGACAAGGCCCTCTACTTGGACTGTGATCTAGTTGTAACGAAAAATCTGGATGACTTGTTTGC
TACAGACTTACAAGATTATCCTTTGGCTGCTGTTAGAGATTTTGGGGGCAGAGCTTATTTTGGTCAAGA
AATCTTTAATGCCGGTGTTCTCTTGGTAAACAATGCTTTTTGGAAAAAAGAGAATATGACCCAAAAATT
AATTGATGTAACCAATGAATGGCATGATAAGGTGATCAGGGAGATCAGAGCATCTTGAATATGCTTTT
TGAACATAAATGGTTGGAATTGGACTTTGATTATAATCATATTGTCATTCATAAACAGTTTGCTGATTA
TCAATTGCCTGAGGGTCAGGATTATCCTGCTATTATTCACTATCTTTCTCATCGGAAACCGTGGAAAGA
TTTGGCGGCCCAAACCTATCGTGAAGTTTGGTGGTACTATCATGGGCTTGAATGGACAGAATTGGGACA
AAACCATCATTTACATCCATTACAAAGATCTCACATCTATCCAATAAAGGAACCTTTCACTTGTCTAAT
CTATACTGCCTCAGACCATATTGAACAAATTGAGACATTGGTTCAATCCTTGCCTGATATTCAGTTTAA
GATAGCAGCTAGAGTAATAGTTAGTGATCGATTGGCTCAGATGACAATTTATCCAAACGTGACTATATT
TAACGGAATTCACTATTTGGTAGATGTCGATAATGAATTGGTAGAAACCAGTCAAGTACTTTTAGATAT
TAATCATGGCGAAAAGACAGAAGAAATTCTCGATCAATTTGCTAATCTTGGCAAGCCTATCTTATCCTT
TGAAAATACTAAAACCTATGAAGTAGGTCAGGAGGCATATGCTGTTGACCAAGTTCAAGCAATGATTGA
AAAATTGAGAGAAATAAGCAAA SP113 amino acid (SEQ ID NO:200)
CLDSIITQTYKNIEIVVVNDGSTDASGEICKEFSEMDHRILYIEQENAGLSAARNTGLNNMSGNYVTFV
DSDDWIEQDYVETLYKKIVEYQADIAVGNYYSFNESEGMFYFHILGDSYYEKVYDNVSIFENLYETQEM
KSFALISAWGKLYKARLFEQLRFDIGKLGEDGYLNQKVYLLSEKVIYLNKSLYAYRIRKGSLSRVWTEK
WMHALVDAMSERITLLANMGYPLEKHLAVYRQMLEVSLANGQASGLSDTATYKEFEMKQRLLNQLSRQE
ESEKKAIVLAANYGYVDQVLTTIKSICYHNRSIRFYLIHSDFPNEWIKQLNKRLEKFDSEIINCRVTSE
QISCYKSDISYTVFLRYFIADEVQEDKALYLDCDLVVTKNLDDLFATDLQDYPLAAVRDFGGRAYFGQE
IFNAGVLLVNNAFWKKENMTQKLIDVTNEWHDKVDQADQSILNMLFEHKWLELDFDYNHIVIHKQFADY
QLPEGQDYPAIIHYLSHRKPWKDLAAQTYREVWWYYHGLEWTELGQNHHLHPLQRSHIYPIKEPETCLI
YTASDHIEQIETLVQSLPDIQFKIAARVIVSDRLAQMTIYPNVTIFNGIHYLVDVDNELVETSQVLLDI TABLE 1-continued

NHGEKTEEILDQFANLGKPILSFENTKTYEVGQEAYAVDQVQAMIEKLREISK

SP114 nucleotide (SEQ ID NO:201)
CATTCAGAAGCAGACCTATCAAAATCTGGAAATTATTCTTGTTGATGATGGTGCAACAGATGAAAGTGG
TCGCTTGTGTGATTCAATCGCTGAACAAGATGACAGGGTGTCAGTGCTTCATAAAAAGAACGAAGGATT
GTCGCAAGCACGAAATGATGGGATGAAGCAGGCTCACGGGGATTATCTGATTTTTATTGACTCAGATGA
TTATATCCATCCAGAAATGATTCAGAGCTTATATGAGCAATTAGTTCAAGAAGATGCGGATGTTTCGAG
CTGTGGTGTCATGAATGTCTATGCTAATGATGAAAGCCCACAGTCAGGCAATCAGGATGACTATTTTGT
CTGTGATTCTCAAACATTTCTAAAGGAATACCTCATAGGTGAAAAAATACCTGGGACGATTTGCAATAA
GCTAATCAAGAGACAGATTGCAACTGCCCTATCCTTTCCTAAGGGGTTGATTTACGAAGATGCCTATTA
CCATTTTGATTTAATCAAGTTGGCCAAGAAGTATGTGGTTAATACTAAACCCTATTATTACTATTTCCA
TAGAGGGGATAGTATTACGACCAAACCCTATGCAGAGAAGGATTTAGCCTATATTGATATCTACCAAAA
GTTTTATAATGAAGTTGTGAAAAACTATCCTGACTTGAAAGAGGTCGCTTTTTTCAGATTGGCCTATGC
CCACTTCTTTATTCTGGATAAGATGTTGCTAGATGATCAGTATAAACAGTTTGAAGCCTATTCTCAGAT
TCATCGTTTTTTAAAAGGCCATGCCTTTGCTATTTCTAGGAATCCAATTTTCCGTAAGGGGAGAAGAAT
TAGTGCTTTGGCCCTATTCATAAATATTTCCTTATATCGATTCTTATTACTGAAAAATATTGAAAAATC
TAAAAAATTACAT SP114 amino acid (SEQ ID NO:202)
IQKQTYQNLEIILVDDGATDESGRLCDSIAEQDDRVSVLHKKNEGLSQARNDGMKQAHGDYLIFIDSDD
YIHPEMIQSLYEQLVQEDADVSSCGVMNVYANDESPQSANQDDYFVCDSQTFLKEYLIGEKIPGTICNK
LIKRQIATALSFPKGLIYEDAYYHFDLIKKAKKYVVNTKPYYYYFHRGDSITTKPYAEKDLAYTDIYQK
FYNEVVKNYPDLKEVAFFRLAYAHFFILDKMLLDDQYKQFEAYSQIHRFLKGKAFAISRNPIFRKGRRI
SALALFINISLYRFLLLKNIEKSKKLH SP115 nucleotide (SEQ ID NO:203)
TAAGGCTGATAATCGTGTTCAAATGAGAACGACGATTAATAATGAATCGCCATTGTGGCTTTCTCCGTT
GTATGGCAATGATAATGGTAACGGATTATGGTGGGGGAACACATTGAAGGGAGCATGGGAAGCTATTCC
TGAAGATGTAAAGCCATATGCAGCGATTGAACTTCATCCTGCAAAAGTCTGTAAACCAACAAGTTGTAT
TCCACGAGATACGAAAGAATTGAGAGAATGGTATGTCAAGATGTTGGAGGAAGCTCAAAGTCTAAACAT
TCCAGTTTTCTTGGTTATTATGTCGGCTGGAGAGCGTAATACAGTTCCTCCAGAGTGGTTAGATGAACA
ATTCCAAAAGTATAGTGTGTTAAAAGGTGTTTTAAATATTGAGAATTATTGGATTTACAATAACCAGTT
AGCTCCGCATAGTGCTAAATATTTGGAAGTTTGTGCCAAATATGGAGCGCATTTTATCTGGCATGATCA
TGAAAAAATGGTTCTGGGAAACTATTATGAATGATCCGACATTCTTTGAAGCGAGTCAAAAATATCAAA
AAATTTGGTGTTGGCAACTAAAAATACGCCAATAAGAGATGATCGGGTACAGATTCTATCGTTAGTGG
ATTTTGGTTGAGTGGCTTATGTGATAACTGGGGCTCATCAACAGATACATGGAAATGGTGGGAAAAACA
TTATACAAACACATTTGAAACTGGAAGAGCTAGGGATATGAGATCCTATGCATCGGAACCAGAATCAAT
GATTGCTATGGAAATGATGAATGTATATACTGGGGGAGGCACAGTTTATAATTTCGAATGTGCCGCGTA
TACATTTATGACAAATGATGTACCAACTCCAGCATTTACTAAAGGTATTATTCCTTTCTTTAGACATGC
TATACAAAATCCAGCTCCAAGTAAGGAAGAAGTTGTAAATAGAACAAAAGCTGTATTTTGGAATGGAGA
AGGTAGGATTAGTTCATTAAACGGATTTTATCAAGGACTTTATTCGAATGATGAAACAATGCCTTTATA
TAATAATGGGAGATATCATATTCCTGTAATACATGAGAAAATTGATAAGGAAAAGATTTCATCTAT
ATTCCCTAATGCAAAAATTTTCACTAAAAATAGTGAGGAATTGTCTAGTAAAGTCAACTATTTAAACTC
GCTTTATCCAAAACTTTATGAAGGAGATGGGTATGCTCAGCGTGTAGGTAATTCCTGGTATATTTATAA
TAGTAATGCTAATATCAATAAAAATCAGCAAGTAATGTTGCCTATGTATACTAATAATACAAAGTCGTT
ATCGTTAGATTTGACGCCACATACTTACGCTGTTGTTAAAGAAAATCCAAATAATTTACATATTTTATT
GAATAATTACAGGACAGATAAGACAGCTATGTGGGCATTATCAGCAAATTTTGATGCATCAAAAAGTTG
GAAGAAAGAAGAATTAGAGTTAGCGAACTGGATAAGCAAAAATTATTCCATCAATCCTGTAGATAATGA
CTTTAGCACAACAACACTTACATTAAAAGGGCATACTGGTCATAAACCTCAGATAAATATAAGTGGCGA
TAAAAATCATTATACTTATACAGAAAATTGGGATGAGAATACCCATGTTTATACCATTACGGTTAATCA
TAATGGAATGGTAGAGATGTCTATAAATACTGAGGGGACAGGTCCAGTCTCTTTCCCAACACCAGATAA
ATTTAATGATGGTAATTTGAATATAGCATATGCAAAACCAACAACACAAAGTTCTGTAGATTACAATGG
AGACCCTAATAGAGCTGTGGATGGTAACAGAAATGGTAATTTTAACTCTGGTTCGGTAACACACACTAG
GGCAGATAATCCCTCTTGGTGGGAAGTCGATTTGAAAAAATGGATAAAGTTGGGCTTGTTAAAATTTA
TAATCGCACAGATGCTGAGACTCAACGTCTATCTAATTTT SP115 amino acid (SEQ ID NO:204)
KADNRVQMRTTINNESPLLLSPLYGNDNGNGLWWGNTLKGAWEAIPEDVKPYAAIELHPAKVCKPTSCI
PRDTKELREWYVKMLEEAQSLNIPVFLVIMSAGERTTVPPEWLDEQFQKYSVLKGVLNIEYYWIYNNQL
APHSAKYLEVCAKYGAHFIWHDHEKWFWETIMNDPTFFEASQKYHKNLVLATKNTPIRDDAGTDSIVSG
FWLSGLCDNWGSSTDTWKWWEKHYTNTFETGRARDMRSYASEPESMIAMEMMNVYTGGGTVYNFECAAY
TFMTNDVPTPAFTKGIIPFFRHAIQNPAPSKEEVVNRTKAVFWNGEGRISSLNGFYQGLYSNDETMPLY
NNGRYHILPVIHEKIDKEKISSIFPNAKILTKNSEELSSKVNYLNSLYPKLYEGDGYAQRVGNSWYIYN
SNANINKNQQVMLPMYTNNTKSLSLDLTPHTYAVVKENPNNLHILLNNYRTDKTAMWALSGNFDASKSW
KKEELELANWISKNYSINPVDNDFRTTTLTLKGHTGHKPQINISGDKNHYTYTENWDENTHVYTITVNH
NGMVEMSINTEGTGPVSFPTPDKFNDGNLNIAYAKPTTQSSVDYNGDPNRAVDGNRNGNFNSGSVTHTR
ADNPSWWEVDLKKMDKVGLVKIYNRTDAETQRLSNF SP117 nucleotide (SEQ ID NO:205)
CTGTGGCAATCAGTCAGCTGCTTCCAAACAGTCAGCTTCAGGAACGATTGAGGTGATTTCACGAGAAAA
TGGCTCTGGGACACGGGGTGCCTTCACAGAAATCACAGGGATTCTCAAAAAAGACGGTGATAAAAAAAT
TGACAACACTGCCAAAACAGCTGTGATTCAAAATAGTACAGAAGGTGTTCTCTCAGCAGTTCAAGGGAA
TGCTAATGCTATCGGCTACATCTCCTTGGGATCTTTAACGAAATCTGTCAAGGCTTTAGAGATTGATGG
TGTCAAGGCTAGTCGAGACACAGTTTTAGATGGTAATACCCTCTTCAACGTCCCTTCAACATTGTTTG
GTCTTGTAATCTTTCCAAGCTAGGTCAAGATTTTATCAGCTTTATCCACTCCAAACAAGGTCAACAAGT
GGTCACAGATAATAAATTTATTGAAGCTAAAACCGAAACCACGGAATATACAAGCCAACACTTATCAGG
CAAGTTGTCTGTTAGGTTCCACTTCAGTATCTTCTTTAATGGAAAAATTAGCAGAAGCTTATAAAAA
AGAAAATCCAGAAGTTACGATTGATATTACCTCTAATGGGTCTTCAGCAGGTATTACCGCTGTTAAGGA
GAAACCGCTGATATTGGTATGGTTTCTAGGGAATTAACTCCTGAAGAAGGTAAGAGTCTCACCCATGA TABLE 1-continued TGCTATTGCTTTAGACGGTATTGCTGTTGTGGTCAATAATGACAATAAGGCAAGCCAAGTCAGTATGGC
TGAACTTGCAGACGTTTTTAGTGGCAAATTAACCACCTGGGACAAGATTAAA SP117 amino acid (SEQ ID NO:206)
CGNQSAASKQSASGTIEVISRENGSGTRGAFTEITGILKKDGDKKIDNTAKTAVIQNSTEGVLSAVQGN
ANAIGYISLGSLTKSVKALEIDGVKASRDTVLDGEYPLQRPFNIVWSSNLSKLGQDFISFIHSKQGGQV
VTDNKFIEAKTETTEYTSQHLSGKLSVVGSTSVSSLMEKLAEAYKKENPEVTIDITSNGSSAGITAVKE
KTADIGMVSRELTPEEGKSLTHDAIALDGIAVVVNNDNKASQVSMAELADVFSGKLTTWDKIK SP118 nucleotide (SEQ ID NO:207)
TTGTCAACAACAACATGCTATTTCTGAGGGGACGAATCAAAGGCAAAGCAGTTCAGCGAAAGTTCCATG
GAAAGCTTCATACACCAACCTAAACAACCAGGTAAGTACAGAAGAGGTCAAATCTCTCTTATCAGCTCA
CTTGGATCCAAATAGTGTTGATGCATTTTTTAATCTCGTTAATGACTATAATACCATTGTCGGCTCAAC
TGGCTTATCAGGAGATTTCACTTCCTTTACTCACACCGAATACGATGTTGAGAAAATCAGTCATCTCTG
GAATCAAAAGAAGGGCGATTTTGTTGGGACCAACTGCCGTATCAATAGTTATTGTCTTTTGAAAAATTC
AGTCACCATTCCAAAGCTTGAAAAGAATGACCAGTTGCTTTTCCTAGATAATGATGCGATTGATAAAGG
AAAGGTCTTTGATTCACAAGATAAGGAAGAGTTTGATATTCTATTTTCGAGAGTTCCAACTGAGTCAAC
TACAGATGTCAAGGTTCACGCTGAAAAGATGGAAGCATTCTTCTCACAATTTCAATTCACAATGAAAGC
TCGAATGCTGTCTGTAGTCTTGCACGACAATTTGGATGGCGAGTATCTGTTTGTAGGCCACGTTGGGGT
CTTAGTACCTGCTGATGACGGTTTCTTATTTGTAGAGAAATTGACTTTCGAAGAGCCCTACCAAGCGAT
TAAATTTGCTAGTAAGGAAGATTGCTACAAGTATTTGGGCACCAAGTATCCGGATTATACAGGCGAGGG
ACTGGCTAAGCCTTTTATCATGGATAATGATAAGTGGGTTAAACTT SP118 amino acid (SEQ ID NO:208)
CQQQHATSEGTNQRQSSSAKVPWKASYTNLNNQVSTEEVKSLLSAHLDPNSVDAFFNLVNDYNTIVGST
GLSGDFTSFTHTEYDVEKISHLWNQKKGDFVGTNCRINSYCLLKNSVTIPKLEKNDQLLFLDNDAIDKG
KVFDSQDKEEFDILFSRVPTESTTDVKVHAEKMEAFFSQFQFNEKARMLSVVLHDNLDGEYLFVGHVGV
LVPADDGFLFVEKLTFEEPYQAIKFASKEDCYKYLGTKYADYTGEGLAKPFIMDNDKWVKL SP119 nucleotide (SEQ ID NO:209)
TTGTTCAGGCAAGTCCGTGACTAGTGAACACCAAACGAAAGATGAAATGAAGACGGAGCAGACAGCTAG
TAAAAACAAGCGCAGCTAAAGGGAAAGAGGTGGCTGATTTTGAATTGATGGGAGTAGATGGCAAGACCTA
CCGTTTATCTGATTACAAGGGCAAGAAAGTCTATCTCAAATTCTGGTGCTTCTTGGTGTTCCATCTGTCT
GGCTAGTCTTCCAGATACGGATGAGATTGCTAAAGAAGCTGGTGATGACTATGTGGTCTTGACAGTAGT
GTCACCAGGACATAAGGGAGAGCAATCTGAAGCGGACTTTAAGAATTGGTATAAGGGATTGGATTATAA
AAATCTCCCAGTCCTAGTTGACCCATCAGGCAAACTTTTGGAAACTTATGGTGTCCGTTCTTACCCAAC
CCAAGCCTTTATAGACAAAGAAGGCAAGCTGGTCAAAACACATCCAGGATTCATGGAAAAAGATGCAAT
TTTGCAAACTTTGAAGGAATTAGCC SP119 amino acid (SEQ ID NO:210)
CSGKSVTSEHQTKDEMKTEQTASKTSAAKGKEVADFELMGVDGKTYRLSDYKGKKVYLKFWASWCSICL
ASLPDTDEIAKEAGDDYVVLTVVSPGHKGEQSEADFKNWYKGLDYKNLPVLVDPSGKLLETYGVRSYPT
QAFIDKEGKLVKTHPGFMEKDAILQTLKELA SP120 nucleotide (SEQ ID NO:211)
CTCGCAAATTGAAAAGGCGGCAGTTAGCCAAGGAGGAAAAGCAGTGAAAAAAACAGAAATTAGTAAAGA
CGCAGACTTGCACGAAATTTATCTAGCTGGAGGTTGTTTCTGGGGAGTGGAGGAATATTTCTCACGTGT
TCCCGGGGTGACGGATGCCGTTTCAGGCTATGCAAATGGTAGAGGAGAAACAACCAAGTACGAATTGAT
TAACCAAACAGGTCATGCAGAAACCGTCCATGTCACCTATGCCAAGCAAATTTCTCTCAAGGAAAT
CCTGCTTCACTATTTCCGCATTATCAATCCAACCAGCAAAAATAAACAAGGAAATGATGTGGGGACCCA
GTACCGTACTGGTGTTTATTACACAGATGACAAGGATTTGGAAGTGATTAACCAAGTCTTTGATGAGGT
GGCTAAGAAATACGATCAACCTCTAGCAGTTGAAAAGGAAAACTTGAAGAATTTTGTGGTGGCTGAGGA
TTACCATCAAGACTATCTCAAGAAAAATCCAAATGGCTACTGCCATATCAATGTTAATCAGGCGGCCTA
TCCTGTCATTGATGCCAGCAAATATCCAAAACCAAGTGATGAGGAATTGAAAAAGACCCTGTCACCTGA
GGAGTATGCAGTTACCCAGGAAAATCAAACAGAACGAGCTTTCTCAAACCGTTACTGGGATAAATTTGA
ATCCGGTATCTATGTGGATATAGCAACTGGGGAACCTCTCTTTTCATCAAAAGACAAATTTGAGTCTGG
TTGTGGCTGGCCTAGTTTTACCCAACCCATCAGTCCAGATGTTGTCACCTACAAGGAAGATAAGTCCTA
CAATATGACGCGTATGGAAGTGCGGAGCCGAGTAGGAGATTCTCACCTTGGGCATGTCTTTACGGATGG
TCCACAGGACAAGGGCGGCTTACGTTACTGTATCAATAGCCTCTCTATCCGCTTTATTCCCAAAGACCA
AATGGAAGAAAAAGGTACGCTTATTTAC SP120 amino acid (SEQ ID NO:212)
SQIEKAAVSQGGKAVKKTEISKDADLHEIYLAGGCFWGVEEYFSRVPGVTDAVSGYANGRGETTKYELI
NQTGHAETVHVTYDAKQISLKEILLHYFRIINPTSKNKQGNDVGTQYRTGVYYTDDKDLEVINQVFDEV
AKKYDQPLAVEKENLKNFVVAEDYHQDYLKKNPNGYCHINVNQAAYPVIDASKYPKPSDEELKKTLSPE
EYAVTQENQTERAFSNRYWDKFESGIYVDIATGEPLFSSKDKFESGCGWFSFTQPISPDVVTYKEDKSY
NMTRMEVRSRVGDSHLGHVFTDGPQDKGGLRYCINSLSIRFIPKDQMEEKGTLIY SP121 nucleotide (SEQ ID NO:213)
TTGTCAGTCAGGTTCTAATGGTTCTCAGTCTGCTGTGTGGATGCTATCAAACAAAAAGGGAAATTAGTTGT
GGCAACCAGTCCTGACTATGCACCCTTTGAATTTCAATCATTGGTTGATGGAAAGAACCAGGTAGTCGG
TGCAGACATCCGACATGGCTCAGGCTATCGCTGATCAACTTGGGGTTAAGTTGGAAATCTCAAGCATGAG
TTTTGACAATGTTTTGACCAGTCTTCAAACTGGTAAGGCTGACCTAGCAGTTGCAGGAATTAGTGCTAC
TGACGAGAGAAAAGAAGTCTTTGATTTTTCAATCCCATACTATGAAAACAAGATTAGTTTCTTGGTTCG
TAAGGCTGATGTGGAAAAATACAAGGATTTAACTAGCCTAGAAAGTGCTAATATTGCAGCCCAAAAAGG
GACTGTTCCAGAATCAATGGTCAAGGAACAATTGCCAAAAGTTCAATTAACTTCCCTAACTAATATGGG
TGAAGCAGTCAATGAATTGCAGGCTGGAAAAATAGATGCTGTTCATATGGATGAGCCTGTTGCACTTAG
TTATGCTGCTAAAAACGCTGGCTTAGCTGTCGCAACTGTCAGCTTGAAGATGAAGGACGGCGACGCCAA
TGCC TABLE 1-continued SP121 amino acid (SEQ ID NO:214)
CQSGSNGSQSAVDAIKQKGKLVVATSPDYAPFEFQSLVDGKNQVVGADIDMAQAIADELGVKLEISSMS
FDNVLTSLQTGKADLAVAGISATDERKEVFDFSIPYEENKISFLVRKADVEKYKDLTSLESANIAAQKG
TVPESMVKEQLPKVQLTSLTNMGEAVNELQAGKIDAVHMDEPVALSYAAKNAGLAVATVSLKMKDGDAN
A SP122 nucleotide (SEQ ID NO:215)
GGAAACTTCACAGGATTTTAAAGAGAAGAAAACAGCAGTCATTAAGGAAAAAGAAGTTGTTAGTAAAAA
TCCTGTGATAGACAATAACACTAGCAATGAAGAAGCAAAAATCAAAGAAGAAAATTCCAATAAATCCCA
AGGAGATTATACGAACTCATTTGTGAATAAAAACACAGAAAATCCCAAAAAAGAAGATAAAGTTGTCTA
TATTGCTGAATTTAAAGATAAAGAATCTGGAGAAAAAGCAATCAAGGAACTATCCAGTCTTAAGAATAC
AAAAGTTTTATATACTTATCATAGAATTTTTAACGGTAGTGCCATAGAAACAACTCCAGATAACTTGGA
CAAAATTAAACAAATAGAAGGTATTTCATCGGTTGAAAGGGCACAAAAAGTCCAACCCATGATGAATCA
TGCCAGAAAGGAAATTGGAGTTGAGGAAGCTATTGATTACCTAAAGTCTATCAATGCTCCGTTTGGGAA
AAATTTTGATGGTAGAGGTATGGTCATTTCAAATATCGATACTGGAACAGATTATAGACATAAGGCTAT
GAGAATCGATGATGATGCCAAAGCCTCAATGAGATTTAAAAAAGAAGACTTAAAAGGCACTGATAAAAA
TTATTGGTTGAGTGATAAAATCCCTCATGCGTTCAATTATTATAATGGTGGCAAAATCACTGTAGAAAA
ATATGATGATGGAAGGGATTATTTTGACCCACATGGGATGCATATTGCAGGGATTCTTGCTGGAAATGA
TACTGAACAAGACATCAAAAACTTTAACGGCATAGATGGAATTGCACCTAATGCACAAATTTTCTCTTA
CAAAATGTATTCTGACGCAGGATCTGGGTTTGCGGGTGATGAAACAATCGTTTCATGCTATTGAAGATTC
TATCAAACACAACGTTGATGTTGTTTCGGTATCATCTGGTTTTACAGGAACAGGTCTTGTAGGTGAGAA
ATATTGGCAAGCTATTCGGGCATTAAGAAAAGCAGGCATTCCAATGGTTGTCGCTACGGGTAACTATGC
GACTTCTGCTTCAAGTTCTTCATGGGATTTAGTAGCAAATAATCATCTGAAAATGACCGACACTGGAAA
TGTAACACGAAGTGCAGCACATGAAGATGCGATAGCGGTCGCTTCTGCTAAAAATCAAACAGTTGAGTT
TGATAAAGTTAACATAGGTGGAGAAAGTTTTAAATACAGAAATATAGGGGCCTTTTTCGATAAGAGTAA
AATCACAACAAATGAAGATGGAACAAAAGCTCCTAGTAAATTAAAATTTGTATATATAGGCAAGGGGCA
AGACCAAGATTTGATAGGTTTGGATCTTAGGGGCAAAATTGCAGTAATGGATAGAATTTATACAAAGGA
TTTAAAAAATGCTTTTAAAAAAGCTATGGATAAGGGTGCACGCGCCATTATGGTTGTAAATACTGTAAA
TTACTACAATAGAGATAATTGGACAGAGCTTCCAGCTATGGGATATGAAGCGGATGAAGGTACTAAAAG
TCAAGTGTTTTCAATTTCAGGAGATGATGGTGTAAAGCTATGGAACATGATTAATCCTGATAAAAAAAC
TGAAGTCAAAAGAAATAATAAAGAAGATTTTAAAGATAAATTGGAGCAATACTATCCAATTGATATGGA
AAGTTTTTAATTCCAACAAACCGAATGTAGGTGACGAAAAAGAGATTGACTTTAAGTTTGCACCTGACAC
AGACAAAGAACTCTATAAAGAAGATATCATCGTTCCAGCAGGATCTACATCTTGGGGGCCAAGAATAGA
TTTACTTTTAAAACCCGATGTTTCAGCACCTGGTAAAAATATTAAATCCACGCTTAATGTTATTAATGG
CAAATCAACTTATGGCTATATGTCAGGAACTAGTATGGCGACTCCAATCGTGGCAGCTTCTACTGTTTT
GATTAGACCGAAATTAAAGGAAATGCTTGAAAGACCTGTATTGAAAAATCTTAAGGGAGATGACAAAAT
AGATCTTACAAGTCTTACAAAAATTGCCCTACAAAATACTGCGCGACCTATGATGGATGCAACTTCTTG
GAAAGAAAAAAGTCAATACTTTGCATCACCTAGACAACAGGGAGCAGGCCTAATTAATGTGGCCAATGC
TTTGAGAAATGAAGTTGTAGCAACTTTCAAAAACACTGATTCTAAAGGTTTGGTAAACTCATATGGTTC
CATTTCTCTTAAAGAAATAAAAGGTGATAAAAAATACTTTACAATCAAGCTTCACAATACATCAAACAG
ACCTTTGACTTTTAAAGTTTCAGCATCAGCTGATAACTACAGATTCTCTAACTGACAGATTAAAAGTTGA
TGAAACATATAAAGATGAAAATCTCCAGATGGTAAGCAAATTGTTCCAGAAATTCACCCAGAAAAAGT
CAAAGGAGCAAATATCACATTTGAGCATGATACTTTCACTATAGGCGCAAATTCTAGCTTTGATTTGAA
TGCGGTTATAAATGTTGGAGAGGCCAAAAACAAAAATAAATTTGTAGAATCATTTATTCATTTTGAGTC
AGTGGAAGCGATGGAAGCTCTAAACTCCAGCGGGAAGAAAATAAACTTCCAACCTTCTTTGTCGATGCC
TCTAATGGGATTTGCTGGGAATTGGAACCACGAACCAATCCTTGATAAATGGGCTTGGGAAGAAGGGTC
AAGATCAAAAACACTGGGAGGTTATGATGATGATGGTAAACCGAAAATTCCAGGAACCTTAAATAAGGG
AATTGGTGGAGAACATGGTATAGATAAATTTAATCCAGCAGGAGTTATACAAAATAGAAAAGATAAAAA
TACAACATCCCTGGATCAAAATCCAGAATTATTTGCTTTCAATAACGAAGGGATCAACGCTCCATCATC
AAGTCGTTGTAAGATTGCTAACATTTATCCTTTAGATTCAAATGGAAATCCTCAAGATGCTCAACTTGA
AAGAGGATTAACACCTTCTCCACTTGTATTAAGAAGTGCAGAAGAAGGATTGATT SP122 amino acid (SEQ ID NO:216)
ETSQDFKEKKTAVIKEKEVVSKNPVIDNNTSNEEAKIKEENSNKSQGDYTDSFVNKNTENPKKEDKVVY
IAEFKDKESGEKAIKELSSLKNTKVLYTYDRIFNGSAIETTPDNLDKIKQIEGISSVERAQKVQPMMNH
ARKEIGVEEAIDYLKSINAPFGKNFDGRGMVISNIDTGTDYRHKAMRIDDDAKASMRFKKEDLKGTDKN
YWLSDKIPHAFNYYNGGKITVEKYDDGRDYFDPHGMHIAGILAGNDTEQDIKNFNGIDGIAPNAQIFSY
KMYSDAGSGFAGDETMFHAIEDSIKHNVDVVSVSSGFTGTGLVGEKYWQAIRALRKAGIPMVVATGNYA
TSASSSSWDLVANNHLKMTDTGNVTRTAAHEDAIAVASAKNQTVEFDKVNIGGESFKYRNIGAFFDKSK
ITTNEDGTKAPSKLKFVYIGKGQDQDLIGLDLRGKIAVMDRIYTKDLKNAFKKAMDKGARAIMVVNTVN
YYNRDNWTELPAMGYEADEGTKSQVFSISGDDGVKLWNMINPDKKTEVKRNNKEDFKDKLEQYYPIDME
SFNSNKPNVGDEKEIDFKFAPDTDKELYKEDIIVPAGSTSWGPRIDLLLKPDVSAPGKNIKSTLNVING
KSTYGYMSGTSMATPIVAASTVLIRPKLKEMLERPVLKNLKGDDKIDLTSLTKIALQNTARPMMDATSW
KEKSQYFASPRQQGAGLINVANALRNEVVATFKNTDSKGLVNSYGSISLKEIKGDKKYFTIKLHNTSNR
PLTFKVSASAITTDSLTDRLKLDETYKDEKSPDGKQIVPEIHPEKVKGANITFEHDTFTIGANSSFDLN
AVINVGEAKNKNKFVESFIHFESVEAMEALNSSGKKINFQPSLSMPLMGFAGNWMHEPILDKWAWEEGS
RSKTLGGYDDDGKPKIPGTLNKGIGGEHGIDKFNPACVIQNRKDKNTTSLDQNPELFAFFNEGINAPSS
SGSKIANIYPLDSNGNPQDAQLERGLTPSPLVLRSAEEGLI SP123 nucleotide (SEQ ID NO:217)
TGTGGTCGAAGTTGAGACTCCTCAATCAATAACAAATCAGGAGCAAGCTAGGACAGAAAACCAAGTAGT
AGAGACAGAGGAAGCTCCAAAAGAAGAAGCACCTAAAACAGAAGAAAGTCCAAAGGAAGAACCAAAATC
GGAGGTAAAACCTACTGACGACACCCTTCCTAAAGTAGAAGAGGGGAAAGAAGATTCAGCAGAACCAGC
TCCAGTTGAAGAAGTAGGTGGAGAAGTTGAGTCAAAAACCAGAGGAAAAAGTAGCAGTTGAGCAGAAGA
TCAACCATCAGACAAACCAGCTGAGGAATCAAAAGTTGAACAAGCAGGTGAACCAGTCGCGCCAAGAGA
AGACGAAAAGGCACCAGTCGAGCCAGAAAAGCAACCAGAAGCTCCTGAAGAAGAAGGCTGTAGAGGA
ACACCGAAACAAGAAGAGTCAACTCCAGATACCAAGGCTGAAGAAACTGTAGAACCAAAAGAGGAGAC
TGTTAATCAATCTATTGAACAACCAAAAGTTGAAACGCCTGCTGTAGAAAAACAAACAGAACCAACGA TABLE 1-continued

```
GGAACCAAAAGTTGAACAAGCAGGTGAACCAGTCGCGCCAAGAGAAGACGAACAGGCACCAACGGCACC
AGTTGAGGCAGAAAAGCAACCAGAAGTTCCTGAAGAAGAGAAGGCTGTAGAGGAAACACCGAAACCAGA
AGATAAAATAAAGGGTATTGGTACTAAAGAACCAGTTGATAAAGTGAGTTAAATAATCAAATTGATAA
AGCTAGTTCAGTTTCTCCTACTGATTATTCTACAGCAAGTTACAATGCTCTTGGACCTGTTTTAGAAAC
TGCAAAAGGTGTCTATGCTTCAGAGCCTGTAAAACAGCCTGAGGTAAATAGCGAGACAAATAAACTTAA
AACGGCTATTGACGCTCTAAACGTTGATAAAACTGAATTAAACAATACGATTGCAGATGCAAAAACAAA
GGTAAAAGAACATTACAGTGATAGAAGTTGGCAAAACCTCCAAACTGAAGTTACAAAGGCTGAAAAAGT
TGCAGCTAATACAGATGCTAAACAAAGTGAAGTTAACGAGGCTGTTGAAAAATTAACTGCAACTATTGA
AAAAATTGGTTGAATTATCTGAAAAGCCAATATTAACATTGACTAGTACCGATAAGAAAATATTGGAACG
TGAAGCTGTTGCTAAGTATACTCTAGAAAATCAAAACAAAACAAAAATCAAATAAATCACAGCTGAATT
GAAAAAAGGAGAAGAAGTTATTAATACTGTAGTCCTTACAGATGACAAGGTAACAACAGAAACTATAAG
CGCTGCATTTAAGAACCTAGAGTACTACAAAGAATACACCCTATCTACAACTATGATTTACGACAGAGG
TAACGGTGAAGAAACTGAAACTCTAGAAAATCAAAATATTCAATTAGATCTTAAAAAAGTTGAGCTTAA
AAATATTAAACGTACAGATTTAATCAAATACGAAATGGAAAAGAAACTAATGAATCACTGATAACAAC
TATTCCTGATGATAAGAGCAATTATTATTTAAAAATAACTTCAAATAATCAGAAAACTACATTACTAGC
TGTTAAAAATATAGAAGAAACTACGGTTAACGGAACACCTGTATATAAAGTTACAGCAATCGCAGACAA
TTTAGTCTCTAGAACTGCTGATAATAAATTTGAAGAAGAA

SP123 amino acid (SEQ ID NO:218)
VVEVETPQSITNQEQARTENQVVETEEAPKEEAPKTEESPKEEPKSEVKPTDDTLPKVEEGKEDSAEPA
PVEEVGGEVESKPEEKVAVKPESQPSDKPAEESKVEQAGEPVAPREDEKAPVEPEKQPEAPEEEKAVEE
TPKQEESTPDTKAEETVEPKEETVNQSIEQPKVETPAVEKQTEPTEEPKVEQAGEPVAPREDEQAPTAP
VEPEKQPEVPEEEKAVEETPKPEDKIKGIGTKEPVDKSELNNQIDKASSVSPTDYSTASYNALGPVLET
AKGVYASEPVKQPEVNSETNKLKTAIDALNVDKTELNNTIADAKTKVKEHYSDRSWQNLQTEVTKAEKV
AANTDAKQSEVNEAVEKLTATIEKLVELSEKPILTLTSTDKKILEREAVAKYTLENQNKTKIKSITAEL
KKGEEVINTVVLTDDKVTTETISAAFKNLEYYKEYTLSTTMIYDRGNGEETETLENQNIQLDLKKVELK
NIKRTDLIKYENGKETNESLITTIPDDKSNYYLKITSNNQKTTLLAVKNIEETTVNGTPVYKVTAIADN
LVSRTADNKFEEE SP124 amino acid (SEQ ID NO:219)
AACACCTGTATATAAAGTTACAGCAATCGCAGACAATTTAGTCTCTAGAACTGCTGATAATAAATTTGA
AGAAGAATACGTTCACTATATTGAAAAACCTAAAGTCCACGAAGATAATGTATATTATAATTTCAAAGA
ATTAGTGGAAGCTATTCAAAACGATCCTTCAAAAGAATATCGTCTGGGACAATCAATGAGCGCTAGAAA
TGTTGTTCCTAATGGAAAATCATATATCACTAAAGAATTCACAGGGAAAACTTTTAAGTTCTGAAGGAAA
ACAATTTGCTATTACTGAATTGGAACATCCATTATTTAATGTGATAACAAACGCAACGATAAATAATGT
GAATTTTGAAAATGTAGAGATAGAACGTTCTGGTCAAGATAATATTGCATCATTAGCCAATACTATGAA
AGGTTCTTCAGTTATTACAAATGTCAAAATTACAGGCACACTTTCAGGTCGTAATAATGTTGCTGGATT
TGTAAATAATATGAATGATGGAACTCGTATTGAAAATGTTGCTTTCTTTGGCAAACTACACTCTACAAG
TGGAAATGGCTCTCATACAGGGGGAATTGCAGGTACAAACTATGAGGAATTGTTAGAAAAGCATATGT
TGATGCTACTATTACAGGAAACAAAACACGCGCCAGCTTGTTACTTCCTAAAGTAGATTATGGATTAAC
TCTAGACCATCTTATTGGTACAAAAGCTCTCCTAACTGAGTCGGTTGTAAAAGGTAAAATAGATGTTTC
AAATCCAGTAGAAGTTGGAGCAATAGCAAGTAAGACTTGGCCTGTAGGTACAGGTAAGTAATTCTGTCAG
CTATGCTAAGATTATCCGTGGAGAGGAGTTATTCGGCTCTAACGACGTTGATGATTCTGATTATGCTAG
TGCTCATATAAAAGATTTATATGCGGTAGAGGGATATTCGTCAGGTAATAGATCATTTAGGAAATCTAA
AACATTTACTAAATTAACTAAAGAACAAGCTGATGCTAAAGTTACTACTTTCAATATTACTGCTGATAA
ATTAGAAAGTGATCTATCTCCTCTTGCAAAACTTAATGAAGAAAAAGCCTATTCTAGTATTCAAGATTA
TAACGCTGAATATAACCAAGCCTATAAAAATCTTGAAAAATTAATACCATTCTACAATAAAGATTATAT
TGTATATCAAGGTAATAAATTAAATAAAGAACACCATCTAAATACTAAAGAAGTTCTTTCTGTTACCGC
GATGACAACAATGAGTTTATCACAAACCTAGATCAAGCTAATAAAATTATTGTTCACTATGCGGACGG
TACAAAAGATTACTTTAACTTGTCTTCTAGCAGTGAAGGTTTAAGTAATGTAAAAGAATATACTATAAC
TGACTTAGGAATTAAATATACACCTAATATCGTTCAAAAAGATAACACTACTCTTGTTAATGATATAAA
ATCTATTTTAGAATCAGTAGAGCTTCAGTCTCAAACGATGTATCAGCATCTAAATCGATTAGGTGACTA
TAGAGTTAATGCAATCAAAGATTTATATTTAGAAGAAAGCTTCACAGATGTTAAAGAAAACTTAACAA
CCTAATCACAAAATTAGTTCAAAACGAAGAACATCAACTAAATGATTCTCCAGCTGCTCGTCAAATGAT
TCGTGATAAAGTCGAGAAAAACAAAGCAGCTTTATTACTAGGGTTTAACTTACCTAAATCGTTACTATGG
AGTTAAATTTGGTGATGTTAATATTAAGAATTAATGCTATTCAAACCAGATTTCTATGGTGAAAAAGT
TAGCGTATTAGACAGATTAATTGAAATCGGTTCTAAAGAGAACAACATTAAAGGTTCACGTACATTCGA
CGCATTCGGTCAAGTA SP124 amino acid (SEQ ID NO:220)
TPVYKVTAIADNLVSRTADNKFEEEYVHYIEKPKVHEDNVYYNFKELVEAIQNDPSKEYRLGQSMSARN
VVPNGKSYITKEFTGKLLSSEGKQFAITELEHPLFNVITNATINNVNFENVEIERSGQDNIASLANTMK
GSSVITNVKITGTLSGRNNVAGFVNNMNDGTRIENVAFFGKLHSTSGNGSHTGGIAGTNYRGIVRKAYV
DATITGNKTRASLLVPKVDYGLTLDHLIGTKALLTESVVKGKIDVSNPVEVGAIASKTWPVGTVSNSVS
YAKIIRGEELFGSNDVDDSDYASAHIKDLYAVEGYSSGNRSFRKSKTFTKLTKEQADAKVTTFNITADK
LESDLSPLAKLNEEKAYSSIQDYNAEYNQAYKNLEKLIPFYNKDYIVYQGNKLNKEHHLNTKEVLSVTA
MNNNEFITNLDEANKIIVHYADGTKDYFNLSSSSEGLSNVKEYTITDLGIKYTPNIVQKDNTTLVNDIK
SILESVELQSQTMYQHLNRLGDYRVNAIKDLYLEESFTDVKENLTNLITKLVQNEEHQLNDSPAARQMI
RDKVEKNKAALLLGLTYLNRYYGVKFGDVNIKELMLFKPDFYGEKVSVLDRLIEIGSKENNIKGSRTFD
AFGQV SP125 nucleotide (SEQ ID NO:221)
ATTAGACAGATTAATTGAAATCGGTTCTAAAGAGAACAACATTAAAGGTTCACGTACATTCGACGCATT
CGGTCAAGTATTGGCTAAATATACTAAATCAGGTAATTTAGATGCATTTTTAAATTATAATAGACAATT
GTTCACAAATATAGACAATATGAACGATTGGTTTATTGATGCTACAGAAGACCATGTCTACATCGCAGA
ACGCGCTTCTGAGGTCGAAGAAATTAAAAATTCTAAACATCGTGCATTCGATAATTTAAAACGAAGTCA
CCTTAGAAATACTATACTCCCACTACTGAATATTGATAAAGCACATCTTTATTTAATTTCAAATTATAA
TGCAATTGCCTTTGGTAGTGCAGAGCGATTAGGTAAAAAATCATTAGAAGATATTAAAGATATCGTTAA
CAAAGCTGCAGATGCTTATAGAAACTATTATGATTTCTGGTATCGTCTAGCCTCTGATAACGTTAAACA
```

TABLE 1-continued

```
ACGACTACTAAGAGATGCTGTTATTCCTATTTGGGAAGGTTATAACGCTCCTGGTGGATGGGTTGAAAA
ATATGGCCGCTATAATACCGACAAAGTATATACTCCTCTTAGAGAATTCTTTGGTCCTATGGATAAGTA
TTATAATTATAATGGAACAGGAGCTTATGCTGCTATATATCCTAACTCTGATGATATTAGAACTGATGT
AAAATATGTTCATTTAGAAATGGTTGGTGAATACGGTATTTCAGTTTACACACATGAAACAACACAGT
CAACGACCGTGCGATTTACTTAGGTGGCTTTGGACACCGTGAAGGTACTGATGCTGAAGCATATGCTCA
GGGTATGCTACAAACTCCTGTTACTGGTAGTGGATTTGATGAGTTTGGTTCTTTAGGTATTAATATGGT
ATTTAAACGCAAAAATGATGGGAATCAGTGGTATATTACAGATCCAAAAACTCTAAAAACACGAGAAGA
TATTAATAGATATATGAAGGGTTATAATGACACTTTAACTCTTCTTGATGAAATTGAGGCTGAATCTGT
GATTTCTCAACAAAATAAAGATTTAAATAGTGCATGGTTCAAAAAAATAGATAGAGAATACCGTGATAA
CAATAAATTAAATCAATGGGATAAAATTCGAAATCTAAGTCAAGAAGAGAAAAATGAATTAAATATTCA
ATCTGTTAATGATTTAGTTGATCAACAATTAATGACTAATCGCAATCCAGGTAATGGTATCTATAAACC
CGAAGCAATTAGCTATAACGATCAATCACCTTATGTAGGTGTTAGAATGATGACCGGTATCTACGGAGG
TAATACTAGTAAAGGTGCTCCTGGAGCTGTTTCATTCAAACATAATGCTTTTAGATTATGGGGTTACTA
CGGATACGAAAATGGGTTCTTAGGTTATGCTTCAAATAAATATAAACAACAATCTAAAACAGATGGTGA
GTCTGTTCTAAGTGATGAATATATTATCAAGAAAATATCTAACAATACATTTAATACTATTGAAGAATT
TAAAAAAGCTTACTTCAAAGAAGTTAAAGATAAAGCAACGAAAGGATTAACAACATTCGAAGTAAATGG
TTCTTCCGTTTCATCATACGATGATTTACTGACATTGTTTAAAGAAGCTGTTAAAAAAGATGCCGAAAC
TCTTAAACAAGAAGCAAACGGTAATAAAACAGTATCTATGAATAATACAGTTAAATTAAAAGAAGCTGT
TTATAAGAAACTTCTTCAACAAACAAATAGCTTTAAAACTTCAATCTTTAAA
```

SP125 amino acid (SEQ ID NO:222)
LDRLIEIGSKENNIKGSRTFDAFGQVLAKYTKSGNLDAFLNYNRQLFTNIDNMNDWFIDATEDHVYIAE
RASEVEEIKNSKHRAFDNLKRSHLRNTILPLLNIDKAHLYLISNYNAIAFGSAERLGKKSLEDIKDIVN
KAADGYRNYYDFWYRLASDNVKQRLLRDAVIPIWEGYNAPGGWVEKYGRYNTDKVYTPLREFFGPMDKY
YNYNGTGAYAAIYPNSDDIRTDVKYVHLEMVGEYGISVYTHETTHVNDRAIYLGGFGHREGTDAEAYAQ
GMLQTPVTGSGFDEFGSLGINMVFKRKNDGNQWYITDPKTLKTREDINRYMKGYNDTLTLLDEIEAESV
ISQQNKDLNSAWFKKIDREYRDNNKLNQWDKIRNLSQEEKNELNIQSVNDLVDQQLMTNRNPNGNGIYKP
EAISYNDQSPYVGVRMMTGIYGGNTSKGAPGAVSFKHNAFRLWGYYGYENGFLGYASNKYKQQSKTDGE
SVLSDEYIIKKISNNTFNTIEEFKKAYFKEVKDKATKGLTTFEVNGSSVSSYDDLLTLFKEAVKKDAET
LKQEANGNKTVSMNNTVKLKEAVYKKLLQQTNSFKTSIFK SP126 nucleotide (SEQ ID NO:223)
```
TAAGACAGATGAACGGAGCAAGGTGTTTGACTTTTCCATTCCCTACTATACTGCAAAAAATAAACTCAT
TGTCAAAAAATCTGACTTGACTACTTATCAGTCTGTAAACGACTTGGCGCAGAAAAAGGTTGGAGCGCA
GAAAGGTTCGATTCAAGAGACGATGGCGAAAGATTTGCTACAAAATTCTTCCCTCGTATCTCTGCCTAA
AAATGGGAATTTAATCACAGATTTAAAATCAGGACAAGTGGATGCCGTTATCTTTGAAGAACCTGTTTC
CAAGGGATTTGTGGAAAATAATCCTGATTTAGCAATCGCAGACCTCAATTTTGAAAAAGAGCAAGATGA
TTCCTACGCGGTAGCCATgAAAAAAGATAGCAAGAAATTGAAGAGGCAGTTCGATAAAACCATTCAAAA
GTTGAAGGAGTCTGGGGAATTAGACAAACTCATTGAGGAAGCCTTA
```

SP126 amino acid (SEQ ID NO:224)
KTDERSKVFDFSIPYYTAKNKLIVKKSDLTTYQSVNDLAQKKVGAQKGSIQETMAKDLLQNSSLVSLPK
NGNLITDLKSGQVDAVIFEEPVSKGFVENNPDLAIADLNFEKEQDDSYAVAMKKDSKKLKRQFDKTIQK
LKESGELDKLIEEAL SP127 nucleotide (SEQ ID NO:225)
```
CTGTGAGAATCAAGCTACACCCAAAGAGACTAGCGCTCAAAAGACAATCGTCCTTGCTACAGCTGGCGA
CGTGCCACCATTTGACTACGAAGACAAGGGCAATCTGACAGGCTTTGATATCGAAGTTTTAAAGGCAGT
AGATGAAAAACTCAGCGACTACGAGATTCAATTCCAAAGAACCGCCTGGGAGAGCATCTTCCCAGGACT
TGATTCTGGTCACTATCAGGCTGCGGCCAATAACTTGAGTTACACAAAAGAGCGTGCTGAAAAATACCT
TTACTCGCTTCCAATTTCCAACAATCCCCTCGTCCTTGTCAGCAACAAGAAAAATCCTTTGACTTCTCT
TGACCAGATCGCTGGTAAAACAACACAAGAGGATACCGGAACTTCTAACGCTCAATTCATCAATAACTG
GAATCAGAAACACACTGATAATCCCGCTACAATTAATTTTTCTGGTGAGGATATTGGTAAACGAATCCT
AGACCTTGCTAACGGAGAGTTTGATTTCCTAGTTTTTGACAAGGTATCCGTTCAAAAGATTATCAAGGA
CCGTGGTTTAGACCTCTCAGTCGTTGATTTACCTTCTGCAGATAGCCCCAGCAATTATATCATTTTCTC
AAGCGACCAAAAAGAGTTTAAAGAGCAATTTGATAAAGCGCTCAAAGAACTCTATCAAGACGGAACCCT
TGAAAAACTCAGCAATACCTATCTAGGTGGTTCTTACCTCCCAGATCAATCTCAGTTACAA
```

SP127 amino acid (SEQ ID NO:226)
CENQATPKETSAQKTIVLATAGDVPPFDYEDKGNLTGFDIEVLKAVDEKLSDYEIQFQRTAWESIFPGL
DSGHYQAAANNLSYTKERAEKYLYSLPISNNPLVLVSNKKNPLTSLDQIAGKTTQEDTGTSNAQFINNW
NQKHTDNPATINFSGEDIGKRILDLANGEFDFLVFDKVSVQKIIKDRGLDLSVVDLPSADSPSNYIIFS
SDQKEFKEQFDKALKELYQDGTLEKLSNTYLGGSYLPDQSQLQ

TABLE 2

S. pneumoniae Antigenic Epitopes

SP001
Lys-1 to Ile-10; Leu-13 to Lys-32; Arg-41 to Ile-51; Ser-85 to Glu-97; Ala-159 to His-168; Val-309 to Thr-318; Val-341 to Asn-352; Asn-415 to Met-430; Phe-454 to Asn-464; Ser-573 to Gly-591; Asn-597 to Thr-641; and Asn-644 to Ala-664.

SP004
Thr-9 to Thr-24; Ile-29 to Ala-48; Thr-49 to Val-56; Val-286 to Val-312; Pro-316 to Glu-344; Val-345 to Ile-367; Gln-368 to Val-399; Ser-400 to Glu-431; Asn-436 to Ala-457; Ile-467 to Ala-498; and Thr-499 to Glu-540.

TABLE 2-continued
S. pneumoniae Antigenic Epitopes

SP006
Glu-1 to Lys-13; Pro-24 to Gly-36; Val-104 to Thr-112; Ala-118 to Asn-130; Trp-137 to Ala-146; Ser-151 to Ile-159; Ile-181 to Leu-188; and Pro-194 to Tyr-202.

SP007
Gly-1 to Asn-7; Tyr-24 to Gln-34; His-47 to Phe-55; Ser-60 to Ala-67; Ala-122 to Leu-129; Leu-221 to Lys-230; Val-236 to Phe-256; and Asp-271 to Gly-283; and Leu-291 to Asp-297.

SP008
Leu-4 to Lys-17; Gln-24 to Leu-32; Asp-60 to Ser-66; Ser-70 to Asp-76; Ala-276 to Lys-283; Asn-304 to Lys-311; and Thr-429 to Pro-437.

SP009
Thr-4 to Glu-11; Leu-50 to Asp-60; Ile-102 to Trp-123; and Ser-138 to Ile-157.

SP010
Phe-34 to Gly-41; Asp-44 to Lys-50; Leu-172 to Val-186; Leu-191 to Val-198; Ser-202 to Ile-209; and Val-213 to Leu-221.

SP011
Asn-2 to Thr-10; Asp-87 to Ala-102; Tyr-125 to Glu-132; Thr-181 to Tyr-189; Arg-217 to Thr-232; Asn-257 to Lys-264; Pro-271 to Ser-278; Tyr-317 to Ala-325; Glu-327 to Pro-337; and Thr-374 to Val-381.

SP012
Gly-1 to Lys-19; Phe-34 to Tyr-41; Leu-109 to Lys-126; and Leu-231 to Glu-247.

SP013
Ala-1 to Lys-12; Ile-42 to Pro-53; Leu-138 to Lys-146; Ile-205 to Lys-217; Ser-235 to Ile-251; and Ser-261 to Tyr-272.

SP014
Gly-1 to Val-16; Leu-35 to Leu-44; Asp-73 to Asp-81; Ile-83 to Asp-92; Glu-145 to Ile-153; Phe-188 to Asn-196; Ser-208 to Phe-215; Ile-224 to Leu-231; and Asn-235 to Ala-243.

SP015
Ser-1 to Pro-16; Asn-78 to Glu-88; Ala-100 to Val-108; Ala-122 to Thr-129; Thr-131 to Ser-137; Leu-201 to Ser-220; and Gly-242 to Val-251.

SP016
Gly-1 to Glu-20; Thr-30 to Val-38; Gln-94 to Asn-105; Lys-173 to Pro-182; Gly-189 to Arg-197; Ser-207 to Val-224; Pro-288 to Leu-298; Ala-327 to Ala-342; and Ser-391 to Ala-402.

SP017
Ser-1 to Thr-12; Ala-36 to Tyr-45; Gln-48 to Ile-54; Lys-59 to Lys-76; Tyr-113 to Leu-138; and Phe-212 to Asp-219.

SP019
Val-97 to Glu-117; Asp-163 to Leu-169; Thr-182 to Thr-191; and Lys-241 to Ser-250.

SP020
Asn-18 to Lys-25; Thr-47 to Glu-60; Trp-75 to Val-84; Gly-102 to Val-110; Pro-122 to Ala-131; and Glu-250 to Pro-258.

SP021
Ser-1 to Asp-8; Val-44 to Asp-54; Ala-117 to Val-125; Thr-165 to Thr-173; and Glu-180 to Pro-189.

SP022
Phe-5 to Lys-13; Thr-20 to Ser-36; Glu-59 to Lys-81; Tyr-85 to Gly-93; Trp-94 to Trp-101; and Thr-195 to Trp-208.

SP023
Gln-45 to Glu-59; Asp-69 to Pro-85; Lys-111 to Asn-121; Pro-218 to Ala-228; and Glu-250 to Asn-281.

SP025
Gln-14 to Thr-20; Gly-27 to Phe-33; Gly-63 to Glu-71; and Ile-93 to Phe-102.

SP028
Asp-171 to Pro-179; Tyr-340 to Glu-350; Pro-455 to Tyr-463; and Asp-474 to Pro-480.

SP030
Leu-22 to Leu-37; Trp-81 to Ala-90; Phe-101 to Ala-106; Thr-124 to Tyr-130; and Asn-138 to Glu-144.

SP031
Asp-8 to Val-16; Gly-27 to Thr-35; Gly-178 to Asp-195; Thr-200 to Asp-209; Trp-218 to Leu-224; and Lys-226 to Asp-241.

SP032
Ser-9 to Asp-28; Phe-31 to Val-40; Gly-42 to Arg-50; Ile-52 to Leu-60; Asp-174 to Phe-186; Leu-324 to Met-333; and Thr-340 to Asn-347.

SP033
Gln-2 to Ile-13; Phe-46 to Ile-53; and Asp-104 to Thr-121.

SP034
Glu-36 to Gly-43; Ala-188 to Asp-196; Trp-313 to Gly-320; and Leu-323 to Leu-329.

SP035
Arg-19 to Asp-36; Asp-47 to Val-57; Asn-134 to Thr-143; Asp-187 to Arg-196; and Glu-222 to Ser-230.

SP036
Arg-10 to Arg-17; Lys-29 to Ser-39; Ser-140 to Ala-153; Arg-158 to Tyr-169; Asp-175 to Ala-183; Gly-216 to Asn-236; Ala-261 to Leu-270; Arg-282 to Phe-291; and Thr-297 to Ala-305; Pro-342 to Gln-362; Phe-455 to Asp-463; His-497 to Thr-511; Ala-521 to Gly-529; Ile-537 to Val-546; Ile-556 to Ala-568; Pro-581 to Ser-595; Glu-670 to Ala-685; Ser-696 to Ala-705 and Leu-782 to Ser-791.

SP038
Glu-61 to Pro-69; Phe-107 to Ala-115; Leu-130 to Tyr-141; Ala-229 to Glu-237; Ser-282 to Asn-287; Ala-330 to Glu-338; and Tyr-387 to Glu-393.

SP039
Ser-28 to Asp-35; Pro-88 to Pro-96; Leu-125 to Arg-135; Phe-149 to Leu-157; Gln-246 to Val-254; Ala-357 to Thr-362; Gly-402 to Lys-411; and Leu-440 to Pro-448.

SP040
Thr-21 to Ile-30; His-54 to Gln-68; Arg-103 to Leu-117; and Thr-127 to Leu-136.

SP041
Gly-36 to Asp-49; Leu-121 to Val-128; and Ala-186 to Ile-196.

SP042
Gly-11 to Arg-19; Ile-23 to Lys-31; His-145 to Asn-151; Gln-159 to Asp-166; Ile-175 to Asp-181; Gly-213 to Tyr-225; Ile-283 to Val-291; Pro-329 to Glu-364; Arg-372 to Ser-386; Thr-421 to Phe-430; Leu-445 to Val-453; Ile-486 to Ala-497; Asp-524 to Ala-535; His-662 to Gly-674; and His-679 to Gln-702.

SP043
Lys-2 to Asp-12; Val-58 to Asn-68; Ser-87 to Asp-95; and Asp-102 to Lys-117.

SP044
Gln-3 to Lys-11; Asp-37 to Tyr-52; Glu-171 to Leu-191; His-234 to Asn-247; and Asn-283 to Ala-291.

SP045
Tyr-52 to Ile-63; Asp-212 to Gln-227; Ser-315 to Thr-332; Leu-345 to Phe-354; Asp-362 to Val-370; Thr-518 to Asn-539; Ala-545 to Lys-559; and Val-601 to Pro-610.

SP046
Gln-9 to Ala-18; Glu-179 to Lys-186; Lys-264 to Glu-271; Gly-304 to

TABLE 2-continued

S. pneumoniae Antigenic Epitopes

Glu-17; Ser-503 to Asn-511; Asn-546 to Thr-553; and Asn-584 to Asp-591.

SP048
Tyr-4 to Asp-25; Lys-33 to Val-70; Asp-151 to Thr-170; Asp-222 to Val-257; Thr-290 to Phe-301; and Gly-357 to Val-367.

SP049
Ala-23 to Arg-37; Tyr-85 to Gln-95; Glu-106 to Ile-118; Arg-131 to ILE-144; Gly-150 to Ser-162; and Ala-209 to Asp-218.

SP050
Asp-95 to Glu-133; Gly-220 to Gly-228; Asn-284 to Glu-295; Thr-298 to Val-315.

SP051
Lys-16 to Glu-50; Lys-57 to Asn-104; Ser-158 to Trp-173; Asp-265 to Pro-279; Val-368 to Tyr-386; Glu-420 to Ile-454; Pro-476 to Ile-516; Phe-561 to Gly-581; Thr-606 to Gly-664; and Glu-676 to Val-696.

SP052
Asn-41 to Tyr-60; Phe-80 to Glu-103; Ala-117 to Val-139; Ile-142 to Leu-155; Val-190 to Lys-212; Glu-276 to Phe-283; Arg-290 to Ser-299 Leu-328 to Val-351; Gly-358 to Thr-388; Glu-472 to Ala-483; Val-533 to Asn-561; Asp-595 to Val-606; Glu-609 to Val-620; Glu-672 to Ser-691.

SP053
Ala-62 to Val-101; Thr-147 to Leu-174; Lys-204 to Val-216; Gln-228 to Val-262; Ser-277 to Gly-297; Thr-341 to Glyn-368; Thr-385 to Ala-409; Thr-414 to Ser-453; Asn-461 to Leu-490; Glu-576 to Thr-625; Gly-630 to Arg-639; and Asp-720 to Leu-740.

SP054
Glu-7 to Val-28; and Tyr-33 to Glu-44.

SP055
Pro-3 to Val-18; Thr-21 to Lys-53; Val-84 to Lys-99; Ile-162 to Val-172; and Val-204 to Ser-241.

SP056
Val-34 to Tyr-41; Leu-47 to Glu-55; and Pro-57 to Gln-66.

SP057
Asp-1 to Val-25; Pro-29 to Ile-80; Asn-96 to Val-145; and Pro-150 to Glu-172.

SP058
Ala-64 to Thr-70; Leu-82 to His-138; and Val-228 to Asn-236.

SP059
Val-10 to Thr-24; Ser-76 to Pro-102; Ser-109 to Ile-119; Ser-124 to Val-130; Thr-186 to Ile-194; and Asn-234 to Ser-243.

SP060
Leu-70 to Arg-76; and Val-79 to Ile-88.

SP062
Glu-14 to Lys-28; Ser-32 to Lys-46; and Glu-66 to Thr-74.

SP063
Ile-10 to Val-25; Val-30 to Thr-40; Asp-44 to Pro-54; Asn-57 to Val-63; Pro-71 to Val-100; and Thr-105 to Thr-116.

SP064
Pro-12 to Leu-32; Val-40 to Leu-68; Asp-95 to Ala-125; Ser-164 to Glu-184; Ser-314 to Glu-346; Asn-382 to Val-393; Leu-463 to Gln-498; Asn-534 to Lys-548; and Lys-557 to Gly-605.

SP065
Asn-2 to Ile-12; Ala-39 to Thr-61; and His-135 to Ala-155.

SP067
Gly-1 to Thr-13; Asp-203 to Asn-218; and Gly-240 to Asp-253.

SP068
Ser-2 to Ser-12; Val-17 to Gln-26; and Lys-54 to Cys-67.

SP069
Ser-32 to Thr-41; Pro-66 to Glu-80; Thr-110 to Val-122; and Val-147 to Thr-180.

SP070
Lys-6 to Tyr-16; Gln-19 to Ile-27; Arg-50 to Ala-58; Leu-112 to Val-128; Ile-151 to Asn-167; Leu-305 to Phe-321.

SP071
Gln-92 to Asn-158; Gln-171 to Gln-188; Val-204 to Val-240; Thr-247 to Ala-273; Glu-279 to Thr-338; Pro-345 to Glu-368; Asn-483 to Lys-539; Val-552 to Ala-568; Glu-575 to Ser-591; Ser-621 to Gly-640; Gln-742 to Gly-758.

SP072
Val-68 to Tyr-81; Tyr-86 to Val-121; Leu-127 to Gly-140; Gly-144 to Ala-155; Gln-168 to Val-185; Asp-210 to Try-241; Glu-246 to Thr-269; Lys-275 to Tyr-295; Gly-303 to Pro-320; Arg-327 to Ile-335; Thr-338 to Thr-364; Tyr-478 to Phe-495; and Tyr-499 to Arg-521.

SP073
Glu-37 to Val-45; Glu-55 to Val-68; Thr-104 to Thr-119; Ile-127 to Tyr-135; Asn-220 to Ile-232; Thr-237 to Ala-250; Ser-253 to Ala-263; Glu-284 to Ile-297; and Met-438 to Asn-455.

SP074
Gly-2 to Ala-12; Gly-96 to Ile-110; and Thr-220 to Phe-239.

SP075
Phe-33 to Tyr-42; Gln-93 to Gly-102; and Val-196 to Asp-211.

SP076
Ser-64 to Leu-76; and Phe-81 to Ala-101.

SP077
Asp-1 to Glu-12; Tyr-26 to Val-36; and Val-51 to Tyr-62.

SP078
Ala-193 to Ile-208; Tyr-266 to Asn-275; Glu-356 to Leu-369; Ala-411 to Gly-422; Ser-437 to Pro-464; Thr-492 to Glu-534; and Glu-571 to Gln-508.

SP079
Gly-11 to Leu-20; Lys-39 to Leu-48; Leu-72 to Val-85; Asn-147 to Ser-158; Ile-178 to Asp-187; Tyr-189 to Gln-201; and Leu-203 to Ala-216

SP080
Ser-2 to Glu-12; Gln-42 to Ala-51; Ala-116 to Ser-127; Phe-131 to Asp-143; and Ile-159 to Ile-171.

SP081
Gln-2 to Leu-9; Gln-49 to Cys-57; Ile-108 to Val-131; Gly-134 to Leu-145; and Trp-154 to Cys-162.

SP082
Ile-101 to Ser-187; Gly-191 to Asn-221; Arg-225 to Arg-236; Tyr-239 to Leu-255; and Gly-259 to Arg-268.

SP083
Ser-28 to Asp-70.

SP084
Leu-42 to Gln-66; Thr-69 to Lys-81; Glu-83 to Arg-92; and Gly-98 to Asn-110.

SP085
Gln-2 to Val-22; and Ser-45 to Glu-51.

SP086
Leu-18 to Gln-65; and Lys-72 to Val-83.

SP087
Ser-45 to Leu-53; and Thr-55 to Gln-63

TABLE 2-continued

S. pneumoniae Antigenic Epitopes

SP088
Pro-8 to Ile-16; Leu-25 to Trp-33; Tyr-35 to Gln-43; Leu-51 to Val-59; Val-59 to Arg-67; Thr-55 to Try-63; Asn-85 to Gly-93; Thr-107 to Leu-115;
Leu-115 to Trp-123; Ala-121 to Thr-129; Tyr-153 to Ala-161; His-176 to Gly-184; Tyr-194 to Ala-202; Ala-217 to Gly-225; and Asn-85 to Gly-93.

SP089
Trp-43 to Ala-51; Gln-68 to Phe-76; Val-93 to Gln-101; Phe-106 to Phe-114; Lys-117 to Lys-125; Trp-148 to Phe-156; Glu-168 to Gln-176; Ile-193 to Try-201; Lys-203 to Lys-211; Glu-212 to Gln-220; Ile-237 to Tyr-245; Lys-247 to Lys-255; Glu-256 to Gln-264; Met-275 to Gly-283; Lys-286 to Gly-294; Trp-292 to Glu-300; Asp-289 to Thr-297; Tyr-315 to Ser-323; Asp-334 to Lys-342; Pro-371 to Arg-379; Arg-485 to Asn-493; Lys-527 to Arg-535; Phe-537 to Met-545; and Tyr-549 to Glu-557.

SP090
Phe-2 to Gln-10; Gln-13 to Lys-21; Tyr-19 to Glu-27; Tyr-39 to Met-47; Pro-65 to Leu-73; Tyr-121 to His-129; Lys-147 to Ile-155; Gly-161 to Lys-169; Gly-218 to Trp-226; Asp-230 to Thr-238; Tyr-249 to Ala-257; and Ala-272 to Gly-280.

SP091
Ser-19 to Ser-27; Asn-25 to Thr-33; Val-51 to Gln-59; Asn-75 to Asn-83; Ile-103 to Trp-111; Tyr-113 to Ala-121; Leu-175 to Asn-183; Glu-185 to Trp-193; Ala-203 to Tyr-211; Val-250 to Phe-258; Asn-260 to Thr-268; Ser-278 to Asp-286; Tyr-305 to Leu-313; Asn-316 to Gly-324; Asn-374 to Asp-382; Asn-441 to Gly-449; and Ser-454 to Gln-462.

SP092
Arg-95 to Glu-103; Ala-216 to Val-224; Leu-338 to Glu-346; Pro-350 to Ala-358; Pro-359 to Ala-367; Pro-368 to Ala-376; Pro-377 to Ala-385; Pro-386 to Ala-394; Pro-395 to Ala-403; Pro-350 to Ala-358; Gln-414 to Lys-422; Pro-421 to Asn-429; Trp-465 to Tyr-473; Phe-487 to Tyr-495; Asn-517 to Gly-525; Trp-586 to Tyr-594; Phe-608 to Tyr-616; and Asp-630
to Gly-638.

SP093
Gln-30 to Ile-38; Gln-52 to Val-60; Ala-108 to His-116; Tyr-133 to Glu-141; Tyr-192 to Ala-200; and Phe-207 to Ser-215.

SP094
Ala-87 to Val-95; Leu-110 to Cys-118; Gln-133 to Leu-141; Ser-185 to Leu-193; Ile-195 to Gly-203; Asp-206 to Gln-214; Ser-211 to Gly-219; Ile-241 to Thr-249.

SP095
Arg-1 to Gln-9; Phe-7 to Asn-15; Thr-21 to Asn-30; Leu-46 to Phe-54; and Ser-72 to Met-80.

SP096
Gly-29 to Ile-37; Glu-52 to Ser-60; and Leu-64 to Gly-72.

SP097
Ala-11 to Thr-19; Glu-53 to Glu-61; Ser-91 to Lys-99; Thr-123 to Gln-131; and Gly-209 to Lys-217.

SP098
Thr-3 to Ser-11; Gly-38 to Phe-46; Tyr-175 to Asn-183; Met-187 to Cys-195; Gln-197 to Leu-205; Tyr-307 to Gln-315; Gly-318 to Tyr-326; Asn-348 to Val-356; Lys-377 to Pro-385; and Leu-415 to Val-423.

SP099
Arg-19 to Gly-27; Asp-76 to Ser-84; Val-90 to Lys-98; Phe-165 to Val0173; Leu-237 to Pro-245.

SP100
His-111 to Gln-119; Ser-141 to His-149; Asp-154 to Ser-162; Gln-158 to Gln-166; Asp-154 to Gln-166; Lys-180 to Gln-188; and Ser-206 to Gln-214.

SP101
Glu-23 to Glu-31; Glu-40 to Val-48; Gln-50 to Ser-58; Thr-61 to Ile-69; Leu-82 to Ile-90; Ala-108 to Leu-116; Gln-121 to Pro-129; and Leu-130 to Thr-138.

SP102
Asp-32 to His-40; Arg-48 to Lys-56; and Asp-102 to Thr-110.

SP103
Arg-5 to Gln-13; Gln-22 to Leu-30; Arg-151 to Gln-159; Arg-167 to Gln-175; Pro-189 to Glu-197; Gly-207 to Leu-215; Ser-219 to Gln-227; Ser-233 to Ser-241; Pro-255 to Asp-264; Lys-272 to Gly-280; Ser-318 to Val-326; Thr-341 to Asp-351; Asn-356 to Thr-364; Val-370 to Tyr-378;
Ile-379 to Gln-387; and Met-435 to Tyr-443.

SP105
Asn-28 to Pro-36; Thr-77 to Phe-85; Arg-88 to Val-96; Gly-107 to Phe-115; Asp-169 to Asp-177; His-248 to Ser-256; and Ser-274 to Ala-282.

SP106
Val-10 to Thr-18; Ile-62 to Tyr-70; Ile-71 to Pro-79; Lys-86 to Gln-94; Lys-100 to Thr-108; Phe-132 to Leu-140; and Asp-145 to Arg-153.

SP107
Asp-33 to Val-41; and Arg-63 to Gln-71.

SP108
Lys-9 to Gln-17; Leu-44 to Ser-52; Ser-63 to Phe-71; Tyr-109 to Ser-117; Ile-183 to Ile-191; Pro-194 to Leu-202; Gly-257 to Gln-265; Ala-323 to Thr-331; and Leu-381 to Tyr-389.

SP109
Asn-2 to Gln-10; Ala-65 to Lys-73; Leu-76 to Glu-84; Thr-111 to Asp-119; Gln-116 to Tyr-124; Tyr-130 to Val-138; Asp-173 to Gly-181; Asp-196 to Ser-204; Asn-231 to Ser-239; Phe-252 to Ser-260; Phe-270 to Tyr-278; Val-291 to His-299; Asp-306 to Leu-314; and Pro-327 to Gly-335.

SP110
Ser-8 to Glu-16; Ile-37 to Val-45; Ala-107 to Val-115; and Gly-122 to Thr-130.

SP111
Asp-19 to Glu-28; Leu-43 to Ala-51; Asn-102 to Phe-110; Gln-133 to Ser-141; Phe-162 to Asp-170; Tyr-194 to Met-202; and Asp-273 to Ser-281.

SP112
Asp-3 to Gln-11; Gly-21 to Ile-29; Ala-46 to Arg-54; Arg-98 to Arg-106; Thr-114 to Val-122; Gln-133 to Asn-141; and Leu-223 to Thr-231.

SP113
Asn-19 to Gly-27; Arg-54 to Ser-62; Val-69 to Gln-77; Ser-117 to Asn-125; Gly-164 to Leu-172; Tyr-193 to Ser-201; Cys-303 to Phe-311; His-315 to Ile-323; Arg-341 to Cys-349; Ile-347 to Ser-355; Arg-403 to Phe-411; Gln-484 to Pro-492; Ser-499 to Leu-507; Ile-541 to Thr-549
Asn-622 to Ile-630; and Glu-645 to Gly-653.

SP114
Gly-17 to Leu-25; His-40 to Gln-48; Arg-49 to Arg-57; Ile-65 to Pro-73;
Asn-101 to Asp-111; Gly-128 to Cys-136; Phe-183 to Thr-191; and Pro-268 to Ile-276.

SP115
Met-8 to Ser-16; Tyr-24 to Leu-32; Cys-68 to Leu-76; Ser-100 to Pro-108; Thr-193 to Thr-201; Gly-238 to Pro-250; Thr-280 to Phe-288; Pro-303 to Asn-312; Trp-319 to Leu-328; Leu-335 to Leu-344; Lys-395 to Ala-403; Asn-416 to Gln-424; Tyr-430 to Ser-438; Val-448 to Leu-456; Leu-460 to Thr-468; Pro-502 to Thr-510; Lys-515 to Ile-524; Gln-523 to His-532; Tyr-535 to Thr-543; Ser-559 to Pro-567; Thr-572 to Asn-580;
Val-594 to Arg-602; Arg-603 to Asn-611; Thr-620 to Trp-628; and Tyr-644 to Arg-653.

TABLE 2-continued

S. pneumoniae Antigenic Epitopes

SP117
Ala-6 to Gly-14; Ile-19 to Thr-27; Thr-99 to Leu-107; Ser-117 to Asp-125; His-131 to Val-139; Ile-193 to Gly-201; and Val-241 to Gln-249.

SP118
Ser-8 to Trp-23; His-46 to Ala-54; Asn-93 to Gly-101; Val-100 to Ser-108; Arg-155 to Asp-163; and His-192 to Leu-200.

SP119
Tyr-46 to Lys-54; Ser-93 to Ser-101; Trp-108 to Asn-116; Val-121 to Glu-129; and Tyr-131 to Gln-139.

SP120
Ala-57 to Lys-65; Leu-68 to Glu-76; Thr-103 to Tyr-116; Tyr-122 to Val-130; His-163 to Gly-173; Asp-188 to Ser-196; Ser-222 to Ser-231; Phe-244 to Ser-252; Pro-262 to Tyr-270; Val-283 to His-291; and Asp-298 to Leu-306.

SP121
Ser-3 to Ala-11; Asp-13 to Leu-21; Ser-36 to Val-44; and Gln-136 to Met-144.

SP122
Asn-28 to Lys-36; Glu-39 to Thr-50; Val-54 to Lys-62; Asn-106 to Leu-114; Phe-159 to Gly-167; Asn-172 to Arg-180; Glu-199 to Asn-207; Lys-230 to His-241; Asn-252 to Gly-263; Met-278 to Ala-287; Thr-346 to Asp-354; Lys-362 to Thr-370; Asp-392 to Asn-405; Asp-411 to Ala-424; Gly-434 to Gly-443; Tyr-484 to Glu-492; Ile-511 to Leu-519; Asn-524 to Asp-538; Glu-552 to Ile-567; Val-605 to Lys-613; Phe-697 to Ala-705; Phe-722 to Leu-730; Leu-753 to Leu-761; Asp-787 to Gln-795; Leu-858 to Asn-866; Ala-892 to Thr-901; Gly-903 to Ile-913; Ile-921 to Asn-931; Asn-938 to Pro-951; Gly-960 to Lys-970; Leu-977 to Asp-985; and Leu-988 to Pro-996.

SP123
Val-4 to Asn-12; Glu-47 to Leu-55; Lys-89 to Glu-100; Ser-165 to Thr-173; Lys-234 to Val-242; Ser-258 to Ser-266; Glu-284 to Asn-292; Tyr-327 to Leu-335; Tyr-457 to Thr-465; Tyr-493 to Glu-501; Thr-506 to Tyr-514; Lys-517 to Thr-525; Asn-532 to Gly-540; and Arg-556 to Glu-564.

SP124
rg-16 to Glu-24; Gln-52 to Arg-60; Asn-69 to Tyr-77; Glu-121 to Asn-129; Ala-134 to Val-142; Thr-151 to Ala-159; Asn-164 to Glu-172; His-181 to His-189; Thr-210 to Ala-218; Ser-244 to Val-252; Phe-287 to Tyr-297; Ser-312 to Thr-323; His-433 to Tyr-441; Ser-445 to Asn-453;
Asn-469 to Thr-477; Asn-501 to Asn-509; Gln-536 to Ala-547; and Gln-608 to Asp-621.

SP125
Ser-9 to Asp-21; Ala-28 to Leu-36; Asn-49 to Phe-57; Val-137 to Arg-145; Asn-155 to Leu-163; Glu-183 to Asp-191; Gly-202 to Tyr-210; Pro-221 to Asp-229; Phe-263 to Ala-271; Phe-300 to Gln-308; Asp-313 to Glu-321; Asn-324 to Asp-332; Ile-346 to Asn-354; Asp-362 to Lys-370; Met-402 to Gly-410; Gly-437 to Gly-445; Ser-471 to Glu-483; Gly-529 to Asp-537; Gln-555 to Val-563; and Leu-579 to Lys-587.

SP126
Leu-22 to Thr-30; Val-65 to Leu-73; and Thr-75 to Asp-83.

SP127
Glu-2 to Ala-12; Asp-28 to Thr-36; Val-105 to Thr-113; Lys-121 to Thr-129; Trp-138 to Pro-146; Ser-152 to Ile-160; Lys-180 to Asp-188; Leu-194 to Asn-202; and Gly-228 to Thr-236.

TABLE 3

S. pneumoniae ORF Cloning Primers

| Primer Name | SEQ ID | Sequence | RE |
|---|---|---|---|
| SP001A | NO:227 | GACTGGATCCTAAAAATCTACGACAATAAAAATC | Bam HI |
| SP001B | NO:228 | CTGAGTCGACTGGTTGTGCTGGTTGAG | Sal I |
| SP004A | NO:229 | GTCAGGATCCAAATTACAATACGGACTATG | Bam HI |
| SP004B | NO:230 | CAGTGTCGACTAACTCTAGGTCGGAAAC | Sal I |
| SP006A | NO:231 | GACTGGATCCTGAGAATCAAGCTACACCCAAAGAG | Bam HI |
| SP006B | NO:232 | AGTCAAGCTTTTGTAACTGAGATTGATCTGG | Hind III |
| SP007A | NO:233 | GACTGGATCCTGGTAACCGCTCTTCTCGTAACGCAGC | Bam HI |
| SP007B | NO:234 | AGTCAAGCTTTTTCAGGAACTTTTACGCTTCC | Hind III |
| SP008A | NO:235 | AGTCAGATCTTGTGGAAATTTGACAGGTAACAGCAAAAAAGCTGC | Bgl II |
| SP008B | NO:236 | ACTGAAGCTTTTTTGTTTTTCAAGAATTCATCG | Hind III |
| SP009A | NO:237 | GACTGGATCCTGGTCAAGGAACTGCTTCTAAAGAC | Bam HI |
| SP009B | NO:238 | AGTCAAGCTTTCACAAATTCGTTGGTGAAGCC | Hind III |
| SP010A | NO:239 | GACTGGATCCTAGCTCAGGTGGAAACGCTGGTTCATCC | Bam HI |
| SP010B | NO:240 | AGTCAAGCTTATCAACTTTTCCACCTTCAACAACC | Hind III |
| SP011A | NO:241 | GTCAAGATCTCTCCAACTATGGTAAATCTGCGGATGG | Bgl II |
| SP011B | NO:242 | AGTCCTGCAGATCCACATCCGCTTTCATCGGGTTAAAGAAGG | Pst I |
| SP012A | NO:243 | GACTGGATCCTGGGAAAAATTCTAGCGAAACTAGTGG | Bam HI |
| SP012B | NO:244 | GTCACTGCAGCTGTCCTTCTTTTACTTCTTTGGTTGC | Pst I |
| SP013A | NO:245 | GACTGGATCCTGCTAGCGGAAAAAAAGATACAACTTCTGG | Bam HI |
| SP013B | NO:246 | CTGAAAGCTTTTTTGCCAATCCTTCAGCAATCTTGTC | Hind III |
| SP014A | NO:247 | GACTAGATCTTGGCTCAAAAAATACAGCTTCAAGTCC | Bgl II |
| SP014B | NO:248 | AGTCCTGCAGGTTTTTGTTTGCTTGGTATTGGTCG | Pst I |
| SP015A | NO:249 | GACTGGATCCTAGTACAAACTCAAGCACTAGTCAGACAGAG | Bam HI |
| SP015B | NO:250 | CAGTCTGCAGTTTCAAAGCTTTTTGTATGTCTTC | Pst I |
| SP016A | NO:251 | GACTGGATCCTGGCAATTCTGGCGGAAGTAAAGATGC | Bam HI |
| SP016B | NO:252 | AGTCAAGCTTGTTTCATAGCTTTTTTGATTGTTTCG | Hind III |
| SP017A | NO:253 | GACTGGATCCTTCACAAGAAAAAACAAAAAATGAAGATGG | Bam HI |

TABLE 3-continued

S. pneumoniae ORF Cloning Primers

| Primer Name | SEQ ID | Sequence | RE |
| --- | --- | --- | --- |
| SP017B | NO:254 | AGTCAAGCTTATCGACGTAGTCTCCGCCTTC | Hind III |
| SP019A | NO:255 | GACTGGATCCGAAAGGTCTGTGGTCAAATAATCTTACC | Bam HI |
| SP019B | NO:256 | AGTCAAGCTTAGAGTTAACATGGTGCTTGCCAATAGG | Hind III |
| SP020A | NO:257 | GACTGGATCCAAACTCAGAAAAGAAAGCAGACAATGC | Bam HI |
| SP020B | NO:258 | AGTCAAGCTTCCAAACTGGTTGATCCAAACCATCTG | Hind III |
| SP021A | NO:259 | GACTGGATCCTTCGAAAGGGTCAGAAGGTGCAGACC | Bam HI |
| SP021B | NO:260 | AGTCAAGCTTCTGTAGGCTTGGTGTGCCCCAGTTGC | Hind III |
| SP022A | NO:261 | CTGAGGATCCGGGGATGGCAGCTTTTAAAAATC | Bam HI |
| SP022B | NO:262 | CAGTAAGCTTGTTTACCCATTCACCATTACC | Hind III |
| SP023A | NO:263 | CAGTGGATCCAGACGAGCAAAAAATTAAG | Bam HI |
| SP023B | NO:264 | TCAGAAGCTTGTTTACCCATTCACCATT | Hind III |
| SP025A | NO:265 | GACTGGATCCCTGTGGTGAGGAAGAAACTAAAAAG | Bam HI |
| SP025B | NO:266 | CTGAGTCGACAATATTCTGTAGGAATGCTTCGAATTTG | Sal I |
| SP028A | NO:267 | CTGAGGATCCGACTTTTAACAATAAAACTATTGAAGAG | Bam HI |
| SP028B | NO:268 | GTCACTGCAGGTTGTCACCTCCAAAAATCACGG | Pst I |
| SP030A | NO:269 | GACTGGATCCCTTTACAGGTAAACAACTACAAGTCGG | Bam HI |
| SP030B | NO:270 | CAGTAAGCTTTTCGAAGTTTGGCTCAGAATTG | Hind III |
| SP031A | NO:271 | GACTGGATCCCCAGGCTGATACAAGTATCGCA | Bam HI |
| SP031B | NO:272 | CAGTAAGCTTATCTGCAGTATGGCTAGATGG | Hind III |
| SP032A | NO:273 | GACTGGATCCGTCTGTATCATTTGAAAACAAAGAAAC | Bam HI |
| SP032B | NO:274 | CAGTCTGCAGTTTTACTGTTGCTGTGCTTGTG | Pst I |
| SP033A | NO:275 | ACTGAGATCTTGGTCAAAAGGAAAGTCAGACAGGAAAGG | Bgl II |
| SP033B | NO:276 | CAGTAAGCTTATTCCTGAGCTTTTTTGATAAAGGTTGCGCA | Hind III |
| SP034A | NO:277 | ACTGGGATCCGAAGGATAGATATATTTTAGCATTTGAGAC | Bam HI |
| SP034B | NO:278 | AGTCAAGCTTCCATGGTATCAAAGGCAAGACTTGG | Hind III |
| SP035A | NO:279 | GTCAGGATCCGGTAGTTAAAGTTGGTATTAACGG | Bam HI |
| SP035A | NO:280 | AGTCAAGCTTGCAATTTTTGCGAAGTATTCCAAGAG | Hind III |
| SP036A | NO:281 | AGTCGGATCCTTCTTACGAGTTGGGACTGTATCAAGC | Bam HI |
| SP036B | NO:282 | AGTCAAGCTTGTTTATTTTTTCCTTACTTACAGATGAAGG | Hind III |
| SP038A | NO:283 | AGTCGGATCCTACTGAGATGCATCATAATCTAGGAGC | Bam HI |
| SP038B | NO:284 | TCAGCTCGAGTTCTTTGACATCTCCATCATAAGTCGC | Xho I |
| SP039A | NO:285 | GACTGGATCCGGTTTTGAGAAAGTATTTGCAGGGG | Bam HI |
| SP039B | NO:286 | CAGTAAGCTTGGATTTTTTCATGGATGCAATTTTTTTGG | Hind III |
| SP040A | NO:287 | GACTGGATCCGACAACATTTACTATCCATACAGTAGAGTCAGC | Bam HI |
| SP040B | NO:288 | GACTAAGCTTGGCATAAGGTTGCAATTCTGGATTAATTGG | Hind III |
| SP041A | NO:289 | GACTGGATCCGGCTAAGGAAAGAGTGGATG | Bam HI |
| SP041B | NO:290 | GACTAAGCTTTTCATTTTTAAATTGACTATGCGCCCG | Hind III |
| SP042A | NO:291 | GACTGGATCCTTGTTCCTATGAACTTGGTCGTCACC | Bam HI |
| SP042B | NO:292 | CATGAAGCTTATCCTGGATTTTTCCAAGTAAATCT | Hind III |
| SP043A | NO:293 | GACTGGATCCTTATAAGGGTGAATTAGAAAAAGG | Bam HI |
| SP043B | NO:294 | GACTAAGCTTCTTATTAGGATTGTTAGTAGTTG | Hind III |
| SP044A | NO:295 | GACTGGATCCGAATGTTCAGGCTCAAGAAAGTTCAGG | Bam HI |
| SP044B | NO:296 | GACTAAGCTTTTCCCCTGATGGAGCAAAGTAATACC | Hind III |
| SP045A | NO:297 | GACTGGATCCCTTGGGTGTAACCCATATCCAGCTCCTTCC | Bam HI |
| SP045B | NO:298 | GACTGTCGACTTCAGCTTGTTTATCTGGGGTTGC | Sal I |
| SP046A | NO:299 | GACTGGATCCTAGTGATGGTACTTGGCAAGGAAAACAG | Bam HI |
| SP046B | NO:300 | ACTGCTGCAGATCTTTGCCACCTAGCTTCTCATTG | Pst I |
| SP048A | NO:301 | GTCAGGATCCTGGGATTCAATATGTCAGAGATGATACTAG | Bam HI |
| SP048B | NO:302 | CTAGAAGCTTACGCACCCATTCACCATTATCATTG | Hind III |
| SP049A | NO:303 | GTCAGGATCCGGATAATAGAGAAGCATTAAAAACC | Bam HI |
| SP049B | NO:304 | AGTCAAGCTTGACAAAATCTTGAAACTCCTCTGGTC | Hind III |
| SP050A | NO:305 | GTCAGGATCCAGATTTTGTCGAGGAGTGTCATACC | Bam HI |
| SP050B | NO:306 | AGTCAAGCTTTCCCTTTTTACCCTTACGAATCCAGG | Hind III |
| SP051A | NO:307 | GACTGGATCCATCTGTAGTTTATGCGGATGAAACACTTATTAC | Bam HI |
| SP051B | NO:308 | GACTGTCGACGCTTTGGTAGAGATAGAAGTCATG | Sal I |
| SP052A | NO:309 | GAGTGGATCCTTACTTTGGTATCGTAGATACAGCCGGC | Bam HI |
| SP052B | NO:310 | AGTCAAGCTTTGTTAATTGCGTACCTTCTAAGCGACC | Hind III |
| SP053A | NO:311 | GACTGGATCCAGCTAAGGTTGCATGGGATGCGATTCG | Bam HI |
| SP053B | NO:312 | GACTGTCGACCTGGGCTTATTAGTTTGACTAGC | Sal I |
| SP054A | NO:313 | CAGTGGATCCCTATCACTATGTAAATAAAGAGA | Bam HI |
| SP054B | NO:314 | ACTGAAGCTTTTCTGTCCCTGTTTGAGGCA | Hind III |
| SP055A | NO:315 | CAGTGGATCCTGAGACTCCTCAATCAATAACAAA | Bam HI |
| SP055B | NO:316 | ACGTAAGCTTATAATCAGTAGGAGAAACTGAACT | Hind III |
| SP056A | NO:317 | CAGTGGATCCGGATGCTCAAGAAACTGCGG | Bam HI |
| SP056B | NO:318 | GACTAAGCTTTTGCCTCTCATTCTTGCTTCC | Hind III |
| SP057A | NO:319 | CAGTGGATCCCGACAAAGGTGAGACTGAG | Bam HI |
| SP057B | NO:320 | ACGTAAGCTTATTTCTTAATTCAAGTGTTTTCTCTG | Hind III |
| SP058A | NO:321 | GACTGGATCCAAATCAATTGGTAGCACAAGATCC | Bam HI |
| SP058B | NO:322 | GACTGTCGACATTAGGAGCCACTGGTCTC | Sal I |
| SP059A | NO:323 | CAGTGGATCCCAAACAGTCAGCTTCAGGAAC | Bam HI |
| SP059B | NO:324 | GACTCTGCAGTTTAATCTTGTCCCAGGTGG | Pst I |
| SP060A | NO:325 | GACTGGATCCATTCGATGATGCGGATGAAAAG | Bam HI |
| SP060B | NO:326 | GACTAAGCTTCATTTGTCTTTGGGTATTTCGCA | Hind III |
| SP062A | NO:327 | CAGTGGATCCGGAGAGTCGATCAAAAGTAG | Bam HI |

TABLE 3-continued

S. pneumoniae ORF Cloning Primers

| Primer Name | SEQ ID | Sequence | RE |
|---|---|---|---|
| SP062B | NO:328 | GTCACTGCAGTTGCTCGTCTCGAGGTTC | Pst I |
| SP063A | NO:329 | CAGTGGATCCATGGACAACAGGAAACTGGGAC | Bam HI |
| SP063B | NO:330 | CAGTAAGCTTATTAGCTTCTGTACCTGTGTTTG | Hind III |
| SP064A | NO:331 | GACTGGATCCCGATGGGCTCAATCCAACCCCAGGTCAAGTC | Bam HI |
| SP064B | NO:332 | GACTCTGCAGCATAGCTTTATCCTCTGACATCATCGTATC | Pst I |
| SP065A | NO:333 | GACTGGATCCTTCCAATCAAAAACAGGCAGATGG | Bam HI |
| SP065B | NO:334 | GACTAAGCTTGAGTCCCATAGTCCAAGGCA | Hind III |
| SP067A | NO:335 | AGTCGGATCCTATCACAGGATCGAACGGTAAGACAACC | Bam HI |
| SP067B | NO:336 | ACTGGTCGACTTCTTTTAACTCCGCTACTGTGTC | Sal I |
| SP068A | NO:337 | CAGTGGATCCAAGTTCATCGAAGATGGTTGGGAAGTCC | Bam HI |
| SP068B | NO:338 | GATCGTCGACCCGCTCCCACATGCTCAACCTT | Sal I |
| SP069A | NO:339 | TGACGGATCCATCGCTAGCTAGTGAAATGCAAGAAAG | Bam HI |
| SP069B | NO:340 | TGACAAGCTTATTCGTTTTTGAACTAGTTGCTTTCGT | Hind III |
| SP070A | NO:341 | GACTGGATCCGCACCAGATGGGGCACAAGGTTCAGGG | Bam HI |
| SP070B | NO:342 | TGACAAGCTTAACTTGTAACGAACAGTTCAATCTG | Hind III |
| SP071A | NO:343 | GACTAGATCTTTTTAACCCAACTGTTGGTACTTTCC | Bgl II |
| SP071B | NO:344 | TGACAAGCTTGTTAGGTGTTACATTTTGACCGTC | Hind III |
| SP072A | NO:345 | ACTGAGATCTTTTTAACCCAACTGTTGGTACTTTC | Bgl II |
| SP072B | NO:346 | GACTAAGCTTTCTACGATAACGATCATTTTCTTTACC | Hind III |
| SP073A | NO:347 | GACTGTCGACTCGTAGATATTTAAGTCTAAGTGAAGCG | Sal I |
| SP073B | NO:348 | AGTCAAGCTTGTTAGGTGTTACATTTTGCAAGTC | Hind III |
| SP074A | NO:349 | GACTGGATCCCTTTGCTTTTGAAGGAAGTAAG | Bam HI |
| SP074B | NO:350 | TGACCTGCAGACGATTTTTGAAAAATGGAGGTGTATC | Pst I |
| SP075A | NO:351 | CAGTGGATCCCTACTACCTCTCGAGAGAAAG | Bam HI |
| SP075B | NO:352 | ACTGAAGCTTTTCGCTTTTTACTCGTTTGACA | Hind III |
| SP076A | NO:353 | CAGTGGATCCTAAGGTCAAAAGTCAGACCGCTAAGAAAGTGC | Bam HI |
| SP076B | NO:354 | CAGTAAGCTTTAGGGTATCCAAATACTGGTTGTTGATG | Hind III |
| SP077A | NO:355 | TGACAGATCTTGACGGGTCTCAGGATCAGACTCAGG | Bgl II |
| SP077B | NO:356 | TGACAAGCTTCAAAGACATCCACCTCTTGACCTTTG | Hind III |
| SP078A | NO:357 | GACTGGATCCTAGAGGCTTTGCCAAATGGTGGGAAGGG | Bam HI |
| SP078B | NO:358 | GTCAGTCGACTTGTTGTAACACTTTTCGAGGTTTGGTACC | Sal I |
| SP079A | NO:359 | CAGTGGATCCTCAAAAAGAGAAGGAAAACTTGG | Bam HI |
| SP079B | NO:360 | CAGTCTGCAGTTTCTTCAACAAACCTTGTTCTTG | Pst I |
| SP080A | NO:361 | CAGTGGATCCCACGTTCTATTGAGGACCACTT | Bam HI |
| SP080B | NO:352 | CAGTAAGCTTTTCCTTCTCAGTCAATTCTTTTCC | Hind III |
| SP081A | NO:363 | GACTGGATCCCGCTCAAAATACCAGAGGTGTTCAG | Bam HI |
| SP081B | NO:364 | GACTAAGCTTAGTACCATGGGTGTGACAGGTTTGAA | Hind III |
| SP082A | NO:365 | CTGAGGATCCAATTGTACAATTAGAAAAAGATAGC | Bam HI |
| SP082B | NO:366 | TGACAAGCTTGCGTTGACTAGGTTCTGCAATGCC | Hind III |
| SP083A | NO:367 | GACTGGATCCTCTGACCAAGCAAAAAGAAGCAGTCAATGA | Bam HI |
| SP083B | NO:368 | TCAGCAGCTGATCATTGACTTTACGATTTGCTCC | Bgl II |
| SP084A | NO:369 | GACTGGATCCGTCCGGCTCTGTCCAGTCCACTTTTTCAGCG | Bam HI |
| SP084B | NO:370 | TCAGAAGCTTATTTTTTGTTTCCTTAATGCGTT | Hind III |
| SP085A | NO:371 | GACTGGATCCGGGACAAATTCAAAAAAAATAGGCAAGAGG | Bam HI |
| SP085B | NO:372 | GTCAAAGCTTTGGCTCTTTGATTGCCAACAACTG | Hind III |
| SP086A | NO:373 | GACTGGATCCTCGCTACCAGCAACAAAGCGAGCAAAGG | Bam HI |
| SP086B | NO:374 | GACTAAGCTTACTTTTTTCTTTTTCCACACGA | Hind III |
| SP087A | NO:375 | CAGTGGATCCGAACCGACAAGTCGCCCACTATCAAGACT | Bam HI |
| SP087B | NO:376 | CTGAAAGCTTTGAATTCTCTTTCTTTTCAGGCT | Hind III |
| SP088A | NO:377 | TCGAGGATCCGGTTGTCGGCTGGCAATATATCCCGT | Bam HI |
| SP088B | NO:378 | CAGTAAGCTTCCGAACCCATTCGCCATTATAGTTGAC | Hind III |
| SP089A | NO:379 | AGTCGGATCCGGCCAAATCAGAATGGGTAGAAGAC | Bam II |
| SP089B | NO:380 | TGACCTGCAGCTTCTCATTGATTTTCATCATCAC | Pst I |
| SP090A | NO:381 | GACTGGATCCATTTGCAGATGATTCTGAAGGATGG | Bam HI |
| SP090B | NO:382 | TCAGCTGCAGCTTAACCCATTCACCATTCTAGTTTAAG | Pst I |
| SP091A | NO:383 | GACTGGATCCTGTCGCTGCAAATGAAACTGAAGTAGC | Bam HI |
| SP091B | NO:384 | GACTAAGCTTATACCAAACGCTGACATCTACGCG | Hind III |
| SP092A | NO:385 | AGTCAGATCTTACGTCTCAGCCTACTTTTGTAAGAGC | Bgl II |
| SP092B | NO:386 | GACTAAGCTTAACCCATTCACCATTGGCATTGAC | Hind III |
| SP093A | NO:387 | CAGTGGATCCTGGACAGGTGAAAGGTCATGCTACATTTGTG | Bam HI |
| SP093B | NO:388 | GACTAAGCTTCAACCATTGAGACCTTGCAACAC | Hind III |
| SP094A | NO:389 | GTCAGGATCCGATTGCTCCTTTGAAGGATTTGAGAGAAACC | Bam HI |
| SP094B | NO:390 | GACTAAGCTTCGATCAAAGATAAGATAAATATATATAAAGT | Hind III |
| SP095A | NO:391 | GACTGGATCCTAGGTCATATGGGACTTTTTTTCTACAACAAAATAGG | Bam HI |
| SP095B | NO:392 | TGACAAGCTTATCTATCAGCTCATTTAATCGTTTTG | Hind III |
| SP096A | NO:393 | CTGAGGATCCCAACGTTGAGAATTATTTGCGAATG | Bam HI |
| SP096B | NO:394 | TGACAAGCTTGAGTCTACAAAAGTAATGTAC | Hind III |
| SP097A | NQ:395 | GTCAGGATCCCTACTATCAATCAAGTTCTTCAGCC | Bam HI |
| SP097B | NO:396 | TGACAAGCTTGACTGAGGCTTGGACCAGATTGAAAAG | Hind III |
| SP098A | NO:397 | GACTGGATCCGACAAAAACATTAAAACGTCCTGAGG | Bam HI |
| SP098B | NO:398 | GACTAAGCTTAGCACGAACTGTGACGCTGGTTCC | Hind III |
| SP099A | NO:399 | GACTGGATCCTTCTCAGGAGACCTTTAAAAATATC | Bam HI |
| SP099B | NO:400 | GACTAAGCTTGTTGGCCATCTTGTACATACC | Hind III |
| SP100A | NO:401 | GACTGGATCCAGTAAATGCGCAATCAAATTC | Bam HI |

TABLE 3-continued

S. pneumoniae ORF Cloning Primers

| Primer Name | SEQ ID | Sequence | RE |
|---|---|---|---|
| SP100B | NO:402 | AGTCCTGCAGGTATTTAGCCCAATAATCTATAAAGCT | Pst I |
| SP101A | NO:403 | CAGTGGATCCTTACCGCGTTCATCAAGATGTC | Bam HI |
| SP101B | NO:404 | GACTAAGCTTGCCAGATGTTGAAAAGAGAGTG | Hind III |
| SP102A | NO:405 | GACTGGATCCGTGGATGGGCTTTAACTATCTTCGTATTCG | Bam HI |
| SP102B | NO:406 | AGTCAAGCTTGCTAGTCTTCACTTTCCCTTTCC | Hind III |
| SP103A | NO:407 | GACTGTCGACACTAAACCAGCATCGTTCGCAGGA | Sal I |
| SP103B | NO:408 | CTGACTGCAGCTTCTTGAAGAAATAATGATTGTGG | Pst I |
| SP105A | NO:409 | CAGTGGATCCTGACTACCTTGAAATCCCACTT | Bam HI |
| SP105B | NO:410 | CAGTAAGCTTTTTTTTAAGGTTGTAGAATGATTTCAATC | Hind III |
| SP106A | NO:411 | CAGTGTCGACTCGTATCTTTTTTGGAGCAATGTT | Sal I |
| SP106B | NO:412 | GACTAAGCTTAAATGTTCCGATACGGGTGATTG | Hind III |
| SP107A | NO:413 | CAGTGGATCCGGACTCTCTCAAAGATGTGAAAG | Bam HI |
| SP107B | NO:414 | GACTAAGCTTCTTGAGTTTGTCAAGGATTGCTTT | Hind III |
| SP108A | NO:415 | CAGTGGATCCCAAGAAATCCTATCATCTCTTCCAGAAG | Bam HI |
| SP108B | NO:416 | GACTAAGCTTTTCAGAACTAAAAGCCGCAGCTT | Hind III |
| SP109A | NO:417 | GACTGGATCCACGAAATGCAGGGCAGACAG | Bam HI |
| SP109B | NO:418 | CAGTAAGCTTATCAACATAATCTAGTAAATAAGCGT | Hind III |
| SP110A | NO:419 | CAGTGGATCCTGTATAGTTTTTAGCGCTTGTTCTTC | Bam HI |
| SP110B | NO:420 | GTCAAAGCTTTGATAGAGTGTCATAATCTTCTTTAG | Hind III |
| SP111A | NO:421 | GACTGGATCCGTGTGTCGAGCATATTCTGAAG | Bam HI |
| SP111B | NO:422 | CAGTAAGCTTACTTTTACCATTTCTTTGTTCTGCATC | Hind III |
| SP112A | NO:423 | GACTGTCGACGTGTTTGGATAGCATTCAGAATCAGACG | Sal I |
| SP112B | NO:424 | CAGTAAGCTTCGGAAGTAAAGACAATTTTCC | Hind III |
| SP113A | NO:425 | CAGTGGATCCGTGCCTAGATAGTATTATTACTCAAAC | Bam HI |
| SP113B | NO:426 | GACTAAGCTTTTTGCTTATTCTCTCAATTTTTC | Hind III |
| SP114A | NO:427 | CAGTGGATCCCATTCAGAAGCAGACCTATCAAAATC | Bam HI |
| SP114B | NO:428 | ACTGAAGCTTATGTAATTTTTTAGATTTTTCAATATTTTCAG | Hind III |
| SP115A | NO:429 | AGTCGGATCCTAAGGCTGATAATCGTGTTCAAATG | Bam HI |
| SP115B | NO:430 | GACTAAGCTTAAAATTAGATAGACGTTGAGT | Hind III |
| SP117A | NO:431 | AGTCGGATCCCTGTGGCAATCAGTCAGCTGCTTCC | Bam HI |
| SP117B | NO:432 | GACTGTCGACTTTAATCTTGTCCCAGGTGGTTAATTTGCC | Sal I |
| SP118A | NO:433 | ACTGGTCGACTTGTCAACAACAACATGCTACTTCTGAG | Sal I |
| SP118B | NO:434 | GACTCTGCAGAAGTTTAACCCACTTATCATTATCC | Pst I |
| SP119A | NO:435 | ACTGGGATCCTTGTTCAGGCAAGTCCGTGACTAGTGAAC | Bam HI |
| SP119B | NO:436 | GACTAAGCTTGGCTAATTCCTTCAAAGTTTGCA | Hind III |
| SP120A | NO:437 | AGTCGGATCCCTCGCAAATTGAAAAGGCGGCAGTTAGCC | Bam HI |
| SP120B | NO:438 | GACTAAGCTTGTAAATAAGCGTACCTTTTTCTTCC | Hind III |
| SP121A | NO:439 | TCAGGGATCCTTGTCAGTCAGGTTCTAATGGTTCTCAG | Bam HI |
| SP121B | NO:440 | AGTCAAGCTTGGCATTGGCGTCGCCGTCCTTC | Hind III |
| SP122A | NO:441 | GACTGGATCCGGAAACTTCACAGGATTTTAAAGAGAAG | Bam HI |
| SP122B | NO:442 | GACTGTCGACAATCAATCCTTCTTCTGCACTTCT | Sal I |
| SP123A | NO:443 | CAGTGGATCCTGTGGTCGAAGTTGAGACTCCTCAATC | Bam HI |
| SP123B | NO:444 | GACTAAGCTTTTCTTCAAATTTATTATCAGC | Hind III |
| SP124A | NO:445 | AGTCGGATCCAACACCTGTATATAAAGTTACAGCAATCG | Bam HI |
| SP124B | NO:446 | GACTGTCGACTACTTGACCGAATGCGTCGAATGTACG | Sal I |
| SP125A | NO:447 | CTGAGGATCCATTAGACAGATTAATTGAAATCGG | Bam HI |
| SP125B | NO:448 | GACTGTCGACTTTAAAGATTGAAGTTTTAAAGCT | Sal I |
| SP126A | NO:449 | TGACGGATCCTAAGACAGATGAACGGAGCAAGGTG | Bam HI |
| SP126B | NO:450 | CTGAAAGCTTTAAGGCTTCCTCAATGAGTTTGTCT | Hind III |
| SP127A | NO:451 | GACTGGATCCCTGTGAGAATCAAGCTACACCCA | Bam HI |
| SP127B | NO:452 | CTGAAAGCTTTTGTAACTGAGATTGATCTGGGAG | Hind III |

SEQUENCE LISTING (452 sequences)

SEQ ID NO: 1 - DNA, 1999 bp; double-stranded, linear
taaaatctacgacaataaaaatcaactcattgctgacttgggttctgaacgccgcgtcaatgcccaagctaatgatattcccacagatttggttaaggcaatcgtttctatcgaagaccatcgcttcttcgaccacagggggattgataccatccgtatcctgggagctttcttgcgcaatctgcaaagcaattccctccaaggtggatcaactctcacccaacagttgattaagttgacttacttttcaacttcgacttccgaccagactatttctcgtaaggctcaggaagcttggttagcgattcagttagaacaaaaagcaaccaagcaagaaatcttgacctactatataaataaggtctacatgtctaatgggaactatggaatgcagacagcagctcaaaactactatggtaaagacctcaataatttaagtttacctcagttagccttgctggctggaatgcctcaggcaccaaaccaatatgacccctattcacatccagaagcagcccaagaccgccgaaacttggtcttatctgaaatgaaaaatcaaggctacatctctgctgaacagtatgagaaagcagtcaatacaccaattactgatggactacaaagtctcaaatcagcaagtaattaccctgcttacatggataattacctcaaggaagtcatcaatcaagttgaagaagaaacaggctataacctactcacaactgggatggatgtctacacaaatgtagaccaagaagctcaaaaacatctgtgggatatttacaatacagacgaatacgttgcctatccagacgatgaattgcaagtcgcttctaccattgttgatgtttctaacggtaaagtcattgcccagctaggagcacgccatcagtcaagtaatgtttccttcggaattaaccaagcagtagaaacaaaccgcgactggggatcaactatgaaaccgatcacagactatgctcctgccttggagtacggtgtctacgattcaactgctactatcgttcacgatgagccctataactaccctgggacaaatactcctgtttataactgggataggggctactttggcaacatcaccttgcaatacgccctgcaacaatcgcgaaacgtcccagccgtggaaactctaaacaaggtcggactcaaccgcgccaagactttcctaaatggtctaggaatcgactacccaagtattcactactcaaatgccatttcaagtaacacaaccgaatcagacaaaaaatatggagcaagtagtgaaaagatggctgctgcttacgctgcctttgcaaatggtggaacttactataaaccaatgtatatccataaagtcgtctttagtgatgggagtgaaaaagagttctctaatgtcggaactcgtgccatgaaggaaacgacagcctatatgatgaccgacatgatgaaaacagtcttgacttatggaactggacgaaatgcctatcttgcttggctccctcaggctggtaaaacaggaacctctaactatacagacgaggaaattgaaaaccacatcaagacctctcaatttgtagcacctgatgaactatttgctggctatacgcgtaaatattcaatggctgtatggacaggctattctaaccgtctgacaccacttgtaggcaatggccttacggtcgctgccaaagtttaccgctctatgatgacctacctgtctgaaggaagcaatccagaagattggaatataccagaggggctctacagaaatggagaattcgtatttaaaaatggtgctcgttctacgtggaactcacctgctccacaacaacccccatcaactgaaagttcaagctcatcatcagatagttcaacttcacagtctagctcaaccactccaagcacaaataatagtacgactaccaatcctaacaataatacgcaacaatcaaatacaacccctgatcaacaaaatcagaatcctcaaccagcacaacca

SEQ ID NO: 2 - protein, 666 aa
KIYDNKNQLIADLGSERRVNAQANDIPTDLVKAIVSIEDHRFFDHRGIDTIRILGAFLRNLQSNSLQGGSTLTQQLIKLTYFSTSTSDQTISRKAQEAWLAIQLEQKATKQEILTYYINKVYMSNGNYGMQTAAQNYYGKDLNNLSLPQLALLAGMPQAPNQYDPYSHPEAAQDRRNLVLSEMKNQGYISAEQYEKAVNTPITDGLQSLKSASNYPAYMDNYLKEVINQVEEETGYNLLTTGMDVYTNVDQEAQKHLWDIYNTDEYVAYPDDELQVASTIVDVSNGKVIAQLGARHQSSNVSFGINQAVETNRDWGSTMKPITDYAPALEYGVYDSTATIVHDEPYNYPGTNTPVYNWDRGYFGNITLQYALQQSRNVPAVETLNKVGLNRAKTFLNGLGIDYPSIHYSNAISSNTTESDKKYGASSEKMAAAYAAFANGGTYYKPMYIHKVVFSDGSEKEFSNVGTRAMKETTAYMMTDMMKTVLTYGTGRNAYLAWLPQAGKTGTSNYTDEEIENHIKTSQFVAPDELFAGYTRKYSMAVWTGYSNRLTPLVGNGLTVAAKVYRSMMTYLSEGSNPEDWNIPEGLYRNGEFVFKNGARSTWNSPAPQQPPSTESSSSSSDSSTSQSSSTTPSTNNSTTTNPNNNTQQSNTTPDQQNQNPQPAQP

SEQ ID NO: 3 - DNA, 1714 bp; double-stranded, linear
aaattacaatacggactatgaattgacctctggagaaaaattacctcttcctaaagagatttcaggttacacttatattggatatatcaaagagggaaaaacgacttctgagtctgaagtaagtaatcaaaagagttcagttgccactcctacaaaacaacaaaaggtggattataatgttacaccgaattttgtagaccatccatcaacagtacaagctattcaggaacaaacacctgtttcttcaactaagccgacagaagttcaagtagttgaaaaacctttctctactgaattaatcaatccaagaaaagaagagaaacaatcttcagattctcaagaacaattagccgaacataagaatctagaaacgaagaaagaggagaagatttctccaaaagaaaagactggggtaaatacattaaatccacaggatgaagttttatcaggtcaattgaacaaacctgaactcttatatcgtgaggaaactatggagacaaaaatagattttcaagaagaaattcaagaaaatcctgatttagctgaaggaactgtaagagtaaaacaagaaggtaaattaggtaagaaagttgaaatcgtcagaatattctctgtaaacaaggaagaagtttcgcgagaaattgtttcaacttcaacgactgcgcctagtccaagaatagtcgaaaaaggtactaaaaaaactcaagttataaaggaacaacctgagactggtgtagaacataaggacgtacagtctggagctattgttgaacccgcaattcagcctgagttgcccgaagctgtagtaagtgacaaaggcgaaccagaagttcaacctacattacccgaagcagttgtgaccgacaaaggtgagactgaggttcaaccagagtcgccagatactgtggtaagtgataaaggtgaaccagagcaggtagcaccgcttccagaatataagggtaatattgagcaagtaaaacctgaaactccggttgagaagaccaaagaacaaggtccagaaaaaactgaagaagttccagtaaaaccaacagaagaaacaccagtaaatccaaatgaaggtactacagaaggaacctcaattcaagaagcagaaaatccagttcaacctgcagaagaatcaacaacgaattcagagaaagtatcaccagatacatctagcaaaaatactggggaagtgtccagtaatcctagtgattcgacaacctcagttggagaatcaaataaaccagaacataatgactctaaaaatgaaaattcagaaaaaactgtagaagaagttccagtaaatccaaatgaaggcacagtagaaggtacctcaaatcaagaaacagaaaaaccagttcaacctgcagaagaaacacaaacaaactctgggaaaatagctaacgaaaatactggagaagtatccaataaacctagtgattcaaaaccaccagttgaagaatcaaatcaaccagaaaaaaacggaactgcaacaaaaccagaaaattcaggtaatacaacatcagagaatggacaaacagaaccagaaccatcaaacggaaattcaactgaggatgtttcaaccgaatcaaacacatccaattcaaatggaaacgaagaaattaaacaagaaaatgaactagaccctgataaaaaggtagaagaaccagagaaaacacttgaattaagaaatgtttccgacctagagtta

SEQ ID NO: 4 - protein, 571 aa
NYNTDYELTSGEKLPLPKEISGYTYIGYIKEGKTTSESEVSNQKSSVATPTKQQKVDYNVTPNFVDHPSTVQAIQEQTPVSSTKPTEVQVVEKPFSTELINPRKEEKQSSDSQEQLAEHKNLETKKEEKISPKEKTGVNTLNPQDEVLSGQLNKPELLYREETMETKIDFQEEIQENPDLAEGTVRVKQEGKLGKKVEIVRIFSVNKEEVSREIVSTSTTAPSPRIVEKGTKKTQVIKEQPETGVEHKDVQSGAIVEPAIQPELPEAVVSDKGEPEVQPTLPEAVVTDKGETEVQPESPDTVVSDKGEPEQVAPLPEYKGNIEQVKPETPVEKTKEQGPEKTEEVPVKPTEETPVNPNEGTTEGTSIQEAENPVQPAEESTTNSEKVSPDTSSKNTGEVSSNPSDSTTSVGESNKPEHNDSKNENSEKTVEEVPVNPNEGTVEGTSNQETEKPVQPAEETQTNSGKIANENTGEVSNKPSDSKPPVEESNQPEKNGTATKPENSGNTTSENGQTEPEPSNGNSTEDVSTESNTSNSNGNEEIKQENELDPDKKVEEPEKTLELRNVSDLEL

SEQ ID NO: 5 - DNA, 748 bp; double-stranded, linear
tgagaatcaagctacacccaaagagactagcgctcaaaagacaatcgtccttgctacagctggcgacgtgccaccatttgactacgaagacaagggcaatctgacaggctttgatatcgaagttttaaaggcagtagatgaaaaactcagcgactacgagattcaattccaaagaaccgcctgggagagcatcttcccaggacttgattctggtcactatcaggctgcggccaataacttgagttacacaaaagagcgtgctgaaaaatacctttactcgcttccaatttccaacaatcccctcgtccttgtcagcaacaagaaaaatcctttgacttctcttgaccagatcgctggtaaaacaacacaagaggataccggaacttctaacgctcaattcatcaataactggaatcagaaacacactgataatcccgctacaattaatttttctggtgaggatattggtaaacgaatcctagaccttgctaacggagagtttgatttcctagtttttgacaaggtatccgttcaaaagattatcaaggaccgtggtttagacctctcagtcgttgatttaccttctgcagatagccccagcaattatatcattttctcaagcgaccaaaaagagtttaaagagcaatttgataaagcgctcaaagaactctatcaagacggaacccttgaaaaactcagcaatacctatctaggtggttcttacctcccagatcaatctcagttacaa

SEQ ID NO: 6 - protein, 249 aa
ENQATPKETSAQKTIVLATAGDVPPFDYEDKGNLTGFDIEVLKAVDEKLSDYEIQFQRTAWESIFPGLDSGHYQAAANNLSYTKERAEKYLYSLPISNNPLVLVSNKKNPLTSLDQIAGKTTQEDTGTSNAQFINNWNQKHTDNPATINFSGEDIGKRILDLANGEFDFLVFDKVSVQKIIKDRGLDLSVVDLPSADSPSNYIIFSSDQKEFKEQFDKALKELYQDGTLEKLSNTYLGGSYLPDQSQLQ

SEQ ID NO: 7 - DNA, 985 bp; double-stranded, linear
tggtaaccgctcttctcgtaacgcagcttcatcttctgatgtgaagacaaaagcagcaatcgtcactgatactggtggtgttgatgacaaatcattcaaccaatcagcttgggaaggtttgcaggcttggggtaaagaacacaatctttcaaaagataacggtttcacttacttccaatcaacaagtgaagctgactacgctaacaacttgcaacaagcggctggaagttacaacctaatcttcggtgttggttttgcccttaataatgcagttaaagatgcagcaaaagaacacactgacttgaactatgtcttgattgatgatgtgattaaagaccaaaagaatgttgcgagcgtaactttcgctgataatgagtcaggttaccttgcaggtgtggctgcagcaaaaacaactaagacaaaacaagttggttttgtaggtggtatcgaatctgaagttatctctcgttttgaagcaggattcaaggctggtgttgcgtcagtagacccatctatcaaagtccaagttgactacgctggttcatttggtgatgcggctaaaggtaaaacaattgcagccgcacaatacgcagccggtgcagatattgtttaccaagtagctggtggtacaggtgcaggtgtctttgcagaggcaaaatctctcaacgaaagccgtcctgaaaatgaaaaagtttgggttatcggtgttgatcgtgaccaagaagcagaaggtaaatacacttctaaagatggcaaagaatcaaactttgttcttgtatctactttgaaacaagttggtacaactgtaaaagatatttctaacaaggcagaaagaggagaattccctggcggtcaagtgatcgtttactcattgaaggataaaggggttgacttggcagtaacaaacctttcagaagaaggtaaaaaagctgtcgaagatgcaaaagctaaaatccttgatggaagcgtaaaagttcctgaaaaa

SEQ ID NO: 8 - protein, 328 aa
GNRSSRNAASSSDVKTKAAIVTDTGGVDDKSFNQSAWEGLQAWGKEHNLSKDNGFTYFQSTSEADYANNLQQAAGSYNLIFGVGFALNNAVKDAAKEHTDLNYVLIDDVIKDQKNVASVTFADNESGYLAGVAAAKTTKTKQVGFVGGIESEVISRFEAGFKAGVASVDPSIKVQVDYAGSFGDAAKGKTIAAAQYAAGADIVYQVAGGTGAGVFAEAKSLNESRPENEKVWVIGVDRDQEAEGKYTSKDGKESNFVLVSTLKQVGTTVKDISNKAERGEFPGGQVIVYSLKDKGVDLAVTNLSEEGKKAVEDAKAKILDGSVKVPEK

SEQ ID NO: 9 - DNA, 1404 bp; double-stranded, linear
tgtggaaatttgacaggtaacagcaaaaaagctgctgattcaggtgacaaacctgttatcaaaatgtaccaaatcggtgacaaaccagacaacttggatgaattgttagcaaatgccaacaaaatcattgaagaaaaagttggtgccaaattggatatccaataccttggctggggtgactatggtaagaaaatgtcagttatcacatcatctggtgaaaactatgatattgcctttgcagataactatattgtaaatgctcaaaaaggtgcttacgctgacttgacagaattgtacaaaaaagaaggtaaagacctttacaaagcacttgacccagcttacatcaagggtaatactgtaaatggtaagatttacgctgttccagttgcagccaacgttgcatcatctcaaaactttgccttcaacggaactctccttgctaaatatggtatcgatatttcaggtgttacttcttacgaaactcttgagccagtcttgaaacaaatcaaagaaaaagctccagacgtagtaccatttgctattggtaaagttttcatcccatctgataattttgactacccagtagcaaacggtcttccattcgttatcgaccttgaaggcgatactactaaagttgtaaaccgttacgaagtgcctcgtttcaaagaacacttgaagactcttcacaaattctatgaagctggctacattccaaaagacgtcgcaacaagcgatacttcctttgaccttcaacaagatacttggttcgttcgtgaagaaacagtaggaccagctgactacggtaacagcttgctttcacgtgttgccaacaaagatatccaaatcaaaccaattactaacttcatcaagnaaaaccaaacaacacaagttgctaactttgtcatctcaaacaactctaagaacaaagaaaaatcaatggaaatcttgaacctcttgaatacgaacccagaactcttgaacggtcttgtttacggtccagaaggcaagaactgggaaaaaattgaaggtaaagaaaaccgtgttcgcgttcttgatggctacaaaggaaacactcacatgggtggatggaacactggtaacaactggatcctttacatcaacgaaaacgttacagaccaacaaatcgaaaattctaagaaagaattggcagaagctaaagaatctccagcgcttggatttatcttcaatactgacaatgtgaaatctgaaatctcagctattgctaacacaatgcaacaatttgatacagctatcaacactggtactgtagacccagataaagcgattccagaattgatggaaaaattgaaatctgaaggtgcctacgaaaaagtattgaacgaaatgcaaaaacaatacgatgaattcttgaaaaacaaaaaa

SEQ ID NO: 10 - protein, 468 aa
CGNLTGNSKKAADSGDKPVIKMYQIGDKPDNLDELLANANKIIEEKVGAKLDIQYLGWGDYGKKMSVITSSGENYDIAFADNYIVNAQKGAYADLTELYKKEGKDLYKALDPAYIKGNTVNGKIYAVPVAANVASSQNFAFNGTLLAKYGIDISGVTSYETLEPVLKQIKEKAPDVVPFAIGKVFIPSDNFDYPVANGLPFVIDLEGDTTKVVNRYEVPRFKEHLKTLHKFYEAGYIPKDVATSDTSFDLQQDTWFVREETVGPADYGNSLLSRVANKDIQIKPITNFIKXNQTTQVANFVISNNSKNKEKSMEILNLLNTNPELLNGLVYGPEGKNWEKIEGKENRVRVLDGYKGNTHMGGWNTGNNWILYINENVTDQQIENSKKELAEAKESPALGFIFNTDNVKSEISAIANTMQQFDTAINTGTVDPDKAIPELMEKLKSEGAYEKVLNEMQKQYDEFLKNKK

SEQ ID NO: 11 - DNA, 937 bp; double-stranded, linear
tggtcaaggaactgcttctaaagacaacaaagaggcagaacttaagaaggttgactttatcctagactggacaccaaataccaaccacacagggctttatgttgccaaggaaaaaggttatttcaaagaagctggagtggatgttgatttgaaattgccaccagaagaaagttcttctgacttggttatcaacggaaaggcaccatttgcagtgtatttccaagactacatggctaagaaattggaaaaaggagcaggaatcactgccgttgcagctattgttgaacacaatacatcaggaatcatctctcgtaaatctgataatgtaagcagtccaaaagacttggttggtaagaaatatgggacatggaatgacccaactgaacttgctatgttgaaaaccttggtagaatctcaaggtggagactttgagaaggttgaaaaagtaccaaataacgactcaaactcaatcacaccgattgccaatggcgtctttgatactgcttggatttactacggttgggatggtatccttgctaaatctcaaggtgtagatgctaacttcatgtacttgaaagactatgtcaaggagtttgactactattcaccagttatcatcgcaaacaacgactatctgaaagataacaaagaagaagctcgcaaagtcatccaagccatcaaaaaaggctaccaatatgccatggaacatccagaagaagctgcagatattctcatcaagaatgcacctgaactcaaggaaaaacgtgactttgtcatcgaatctcaaaaatacttgtcaaaagaatacgcaagcgacaaggaaaaatggggtcaatttgacgcagctcgctggaatgctttctacaaatgggataaagaaaatggtatccttaaagaagacttgacagacaaaggcttcaccaacgaatttgtgaaa

SEQ ID NO: 12 - protein, 312 aa
GQGTASKDNKEAELKKVDFILDWTPNTNHTGLYVAKEKGYFKEAGVDVDLKLPPEESSSDLVINGKAPFAVYFQDYMAKKLEKGAGITAVAAIVEHNTSGIISRKSDNVSSPKDLVGKKYGTWNDPTELAMLKTLVESQGGDFEKVEKVPNNDSNSITPIANGVFDTAWIYYGWDGILAKSQGVDANFMYLKDYVKEFDYYSPVIIANNDYLKDNKEEARKVIQAIKKGYQYAMEHPEEAADILIKNAPELKEKRDFVIESQKYLSKEYASDKEKWGQFDAARWNAFYKWDKENGILKEDLTDKGFTNEFVK

SEQ ID NO: 13 - DNA, 799 bp; double-stranded, linear
tagctcaggtggaaacgctggttcatcctctggaaaaacaactgccaaagctcgcactatcgatgaaatcaaaaaaagcggtgaactgcgaatcgccgtgtttggagataaaaaaccgtttggctacgttgacaatgatggttctaccaaggtacgctacgatattgaactagggaaccaactagctcaagaccttggtgtcaaggttaaatacatttcagtcgatgctgccaaccgtgcggaatacttgatttcaaacaaggtagatattactcttgctaactttacagtaactgacgaacgtaagaaacaagttgattttgcccttccatatatgaaagtttctctgggtgtcgtatcacctaagactggtctcattacagacgtcaaacaacttgaaggtaaaaccttaattgtcacaaaaggaacgactgctgagacttattttgaaaagaatcatccagaaatcaaactccaaaaatacgaccaatacagtgactcttaccaagctcttcttgacggacgtggagatgccttttcaactgacaatacggaagttctagcttgggcgcttgaaaataaaggatttgaagtaggaattacttccctcggtgatcccgataccattgcggcagcagttcaaaaaggcaaccaagaattgctagacttcatcaataaagatattgaaaaattaggcaaggaaaacttcttccacaaggcctatgaaaagacacttcacccaacctacggtgacgctgctaaagcagatgacctggttgttgaaggtggaaaagttgat

SEQ ID NO: 14 - protein, 266 aa
SSGGNAGSSSGKTTAKARTIDEIKKSGELRIAVFGDKKPFGYVDNDGSTKVRYDIELGNQLAQDLGVKVKYISVDAANRAEYLISNKVDITLANFTVTDERKKQVDFALPYMKVSLGVVSPKTGLITDVKQLEGKTLIVTKGTTAETYFEKNHPEIKLQKYDQYSDSYQALLDGRGDAFSTDNTEVLAWALENKGFEVGITSLGDPDTIAAAVQKGNQELLDFINKDIEKLGKENFFHKAYEKTLHPTYGDAAKADDLVVEGGKVD

SEQ ID NO: 15 - DNA, 1189 bp; double-stranded, linear
ctccaactatggtaaatctgcggatggcacagtgaccatcgagtatttcaaccagaaaaaagaaatgaccaaaaccttggaagaaatcactcgtgattttgagaaggaaaaccctaagatcaaggtcaaagtcgtcaatgtaccaaatgctggtgaagtattgaagacacgcgttctcgcaggagatgtgcctgatgtggtcaatatttacccacagtccatcgaactgcaagaatgggcaaaagcaggtgtttttgaagatttgagcaacaaagactacctgaaacgcgtgaaaaatggctacgctgaaaaatatgctgtaaacgaaaaagtttacaacgttccttttacagctaatgcttatggaatttactacaacaaagataaattcgaagaactgggcttgaaggttcctgaaacctgggatgaatttgaacagttagtcaaagatatcgttgctaaaggacaaacaccatttggaattgcaggtgcagatgcttggacactcaatggttacaatcaattagcctttgcgacagcaacaggtggaggaaaagaagcaaatcaataccttcgttattctcaaccaaatgccattaaattgtcggatccgattatgaaagatgatatcaaggtcatggacatccttcgcatcaatggatctaagcaaaagaactgggaaggtgctggctataccgatgttatcggagccttcgcacgtggggatgtcctcatgacaccaaatgggtcttgggcgatcacagcgattaatgaacaaaaaccgaactttaagattgggaccttcatgattccaggaaaagaaaaaggacaaagcttaaccgttggtgcgggagacttggcatggtctatctcagccaccaccaaacatccaaaagaagccaatgcctttgtggaatatatgacccgtccagaagtcatgcaaaaatactacgatgtggacggatctccaacagcgatcgaaggggtcaaacaagcaggagaagattcaccgcttgctggtatgaccgaatatgcctttacggatcgtcacttggtctggttgcaacaatactggaccagtgaagcagacttccataccttgaccatgaactatgtcttgaccggtgataaacaaggcatggtcaatgatttgaatgccttctttaacccgatgaaagcggatgtggat

SEQ ID NO: 16 - protein, 396 aa
SNYGKSADGTVTIEYFNQKKEMTKTLEEITRDFEKENPKIKVKVVNVPNAGEVLKTRVLAGDVPDVVNIYPQSIELQEWAKAGVFEDLSNKDYLKRVKNGYAEKYAVNEKVYNVPFTANAYGIYYNKDKFEELGLKVPETWDEFEQLVKDIVAKGQTPFGIAGADAWTLNGYNQLAFATATGGGKEANQYLRYSQPNAIKLSDPIMKDDIKVMDILRINGSKQKNWEGAGYTDVIGAFARGDVLMTPNGSWAITAINEQKPNFKIGTFMIPGKEKGQSLTVGAGDLAWSISATTKHPKEANAFVEYMTRPEVMQKYYDVDGSPTAIEGVKQAGEDSPLAGMTEYAFTDRHLVWLQQYWTSEADFHTLTMNYVLTGDKQGMVNDLNAFFNPMKADVD

SEQ ID NO: 17 - DNA, 775 bp; double-stranded, linear
tgggaaaaattctagcgaaactagtggagataattggtcaaagtaccagtctaacaagtctattactattggatttgatagtacttttgttccaatgggatttgctcagaaagatggttcttatgcaggatttgatattgatttagctacagctgtttttgaaaaatacggaatcacggtaaattggcaaccgattgattgggatttgaaagaagctgaattgacaaaaggaacgattgatctgatttggaatggctattccgctacagacgaacgccgtgaaaaggtggctttcagtaactcatatatgaagaatgagcaggtattggttacgaagaaatcatctggtatcacgactgcaaaggatatgactggaaagacattaggagctcaagctggttcatctggttatgcggactttgaagcaaatccagaaattttgaagaatattgtcgctaataaggaagcgaatcaataccaaacctttaatgaagccttgattgatttgaaaaacgatcgaattgatggtctattgattgaccgtgtctatgcaaactattatttagaagcagaaggtgttttaaacgattataatgtctttacagttggactagaaacagaagcttttgcggttggagcccgtaaggaagatacaaacttggttaagaagataaatgaagctttttctagtctttacaaggacggcaagttccaagaaatcagccaaaaatggtttggagaagatgtagcaaccaaagaagtaaaagaaggacag

SEQ ID NO: 18 - protein, 258 aa
GKNSSETSGDNWSKYQSNKSITIGFDSTFVPMGFAQKDGSYAGFDIDLATAVFEKYGITVNWQPIDWDLKEAELTKGTIDLIWNGYSATDERREKVAFSNSYMKNEQVLVTKKSSGITTAKDMTGKTLGAQAGSSGYADFEANPEILKNIVANKEANQYQTFNEALIDLKNDRIDGLLIDRVYANYYLEAEGVLNDYNVFTVGLETEAFAVGARKEDTNLVKKINEAFSSLYKDGKFQEISQKWFGEDVATKEVKEGQ

SEQ ID NO: 19 - DNA, 868 bp; double-stranded, linear
tgctagcggaaaaaaagatacaacttctggtcaaaaactaaaagttgttgctacaaactcaatcatcgctgatattactaaaaatattgctggtgacaaaattgaccttcatagtatcgttccgattgggcaagacccacacgaatacgaaccacttcctgaagacgttaagaaaacttctgaggctaatttgattttctataacggtatcaaccttgaaacaggtggcaatgcttggtttacaaaattggtagaaaatgccaagaaaactgaaaacaaagactacttcgcagtcagcgacggcgttgatgttatctaccttgaaggtcaaaatgaaaaaggaaaagaagacccacacgcttggcttaaccttgaaaacggtattatttttgctaaaaatatcgccaaacaattgagcgccaaagaccctaacaataaagaattctatgaaaaaaatctcaaagaatatactgataagttagacaaacttgataaagaaagtaaggataaatttaataagatccctgctgaaaagaaactcattgtaaccagcgaaggagcattcaaatacttctctaaagcctatggtgtcccaagtgcttacatctgggaaatcaatactgaagaagaaggaactcctgaacaaatcaagaccttggttgaaaaacttcgccaaacaaaagttccatcactctttgtagaatcaagtgtggatgaccgtccaatgaaaactgtttctcaagacacaaacatcccaatctacgctcaaatctttactgactctatcgcagaacaaggtaaagaaggcgacagctactacagcatgatgaaatacaaccttgacaagattgctgaaggattggcaaaa

SEQ ID NO: 20 - protein, 289 aa
ASGKKDTTSGQKLKVVATNSIIADITKNIAGDKIDLHSIVPIGQDPHEYEPLPEDVKKTSEANLIFYNGINLETGGNAWFTKLVENAKKTENKDYFAVSDGVDVIYLEGQNEKGKEDPHAWLNLENGIIFAKNIAKQLSAKDPNNKEFYEKNLKEYTDKLDKLDKESKDKFNKIPAEKKLIVTSEGAFKYFSKAYGVPSAYIWEINTEEEGTPEQIKTLVEKLRQTKVPSLFVESSVDDRPMKTVSQDTNIPIYAQIFTDSIAEQGKEGDSYYSMMKYNLDKIAEGLAK

SEQ ID NO: 21 - DNA, 1546 bp; double-stranded, linear
tggctcaaaaaatacagcttcaagtccagattataagttggaaggtgtaacattcccgcttcaagaaaagaaaacattgaagtttatgacagccagttcaccgttatctcctaaagacccaaatgaaaagttaattttgcaacgtttggagaaggaaactggcgttcatattgactggaccaactaccaatccgactttgcagaaaaacgtaacttggatatttctagtggtgatttaccagatgctatccacaacgacggagcttcagatgtggacttgatgaactgggctaaaaaaggtgttattattccagttgaagatttgattgataaatacatgccaaatcttaagaaaattttggatgagaaaccagagtacaaggccttgatgacagcacctgatgggcacatttactcatttccatggattgaagagcttggagatggtaaagagtctattcacagtgtcaacgatatggcttggattaacaaagattggcttaagaaacttggtcttgaaatgccaaaaactactgatgatttgattaaagtcctagaagctttcaaaaacggggatccaaatggaaatggagaggctgatgaaattccattttcatttattagtggtaacggaaacgaagattttaaattcctatttgctgcatttggtataggggataacgatgatcatttagtagtaggaaatgatggcaaagttgacttcacagcagataacgataactataaagaaggtgtcaaatttatccgtcaattgcaagaaaaaggcctgattgataaagaagctttcgaacatgattggaatagttacattgctaaaggtcatgatcagaaatttggtgtttactttacatgggataagaataatgttactggaagtaacgaaagttatgatgttttaccagtacttgctggaccaagtggtcaaaaacacgtagctcgtacaaacggtatgggatttgcacgtgacaagatggttattaccagtgtaaacaaaaacctagaattgacagctaaatggattgatgcacaatacgctccactccaatctgtgcaaaataactggggaacttacggagatgacaaacaacaaaacatctttgaattggatcaagcgtcaaatagtctaaaacacttaccactaaacggaactgcaccagcagaacttcgtcaaaagactgaagtaggaggaccactagctatcctagattcatactatggtaaagtaacaaccatgcctgatgatgccaaatggcgtttggatcttatcaaagaatattatgttccttacatgagcaatgtcaataactatccaagagtctttatgacacaggaagatttggacaagattgcccatatcgaagcagatatgaatgactatatctaccgtaaacgtgctgaatggattgtaaatggcaatattgatactgagtgggatgattacaagaaagaacttgaaaaatacggactttctgattacctcgctattaaacaaaaatactacgaccaataccaagcaaacaaaaac

SEQ ID NO: 22 - protein, 515 aa
GSKNTASSPDYKLEGVTFPLQEKKTLKFMTASSPLSPKDPNEKLILQRLEKETGVHIDWTNYQSDFAEKRNLDISSGDLPDAIHNDGASDVDLMNWAKKGVIIPVEDLIDKYMPNLKKILDEKPEYKALMTAPDGHIYSFPWIEELGDGKESIHSVNDMAWINKDWLKKLGLEMPKTTDDLIKVLEAFKNGDPNGNGEADEIPFSFISGNGNEDFKFLFAAFGIGDNDDHLVVGNDGKVDFTADNDNYKEGVKFIRQLQEKGLIDKEAFEHDWNSYIAKGHDQKFGVYFTWDKNNVTGSNESYDVLPVLAGPSGQKHVARTNGMGFARDKMVITSVNKNLELTAKWIDAQYAPLQSVQNNWGTYGDDKQQNIFELDQASNSLKHLPLNGTAPAELRQKTEVGGPLAILDSYYGKVTTMPDDAKWRLDLIKEYYVPYMSNVNNYPRVFMTQEDLDKIAHIEADMNDYIYRKRAEWIVNGNIDTEWDDYKKELEKYGLSDYLAIKQKYYDQYQANKN

SEQ ID NO: 23 - DNA, 895 bp; double-stranded, linear
tagtacaaactcaagcactagtcagacagagaccagtagctctgctccaacagaggtaaccattaaaagttcactggacgaggtcaaactttccaaagttcctgaaaagattgtgacctttgacctcggcgctgcggatactattcgcgctttaggatttgaaaaaaatatcgtcggaatgcctacaaaaactgttccgacttatctaaaagacctagtgggaactgtcaaaaatgttggttctatgaaagaacctgatttagaagctatcgccgcccttgagcctgatttgattatcgcttcgccacgtacacaaaaattcgtagacaaattcaaagaaatcgccccaaccgttctcttccaagcaagcaaggacgactactggacttctaccaaggctaatatcgaatccttagcaagtgccttcggcgaaactggtacacagaaagccaaggaagaattgaccaagctagacaagagcatccaagaagtcgctactaaaaatgaaagctctgacaaaaaagcccttgcgatcctccttaatgaaggaaaaatggcagcctttggtgccaaatctcgtttctctttcttgtaccaaaccttgaaattcaaaccaactgatacaaaatttgaagactcacgccacggacaagaagtcagctttgaaagtgtcaaagaaatcaaccctgacatcctctttgtcatcaaccgtacccttgccatcggtggggacaactctagcaacgacggtgtcctagaaaatgcccttatcgctgaaacacctgctgctaaaaatggtaagattatccaactaacaccagacctctggtatctaagcggaggcggacttgaatcaacaaaactcatgattgaagacatacaaaaagctttgaaa

SEQ ID NO: 24 - protein, 298 aa
STNSSTSQTETSSSAPTEVTIKSSLDEVKLSKVPEKIVTFDLGAADTIRALGFEKNIVGMPTKTVPTYLKDLVGTVKNVGSMKEPDLEAIAALEPDLIIASPRTQKFVDKFKEIAPTVLFQASKDDYWTSTKANIESLASAFGETGTQKAKEELTKLDKSIQEVATKNESSDKKALAILLNEGKMAAFGAKSRFSFLYQTLKFKPTDTKFEDSRHGQEVSFESVKEINPDILFVINRTLAIGGDNSSNDGVLENALIAETPAAKNGKIIQLTPDLWYLSGGGLESTKLMIEDIQKALK

SEQ ID NO: 25 - DNA, 1261 bp; double-stranded, linear
tggcaattctggcggaagtaaagatgctgccaaatcaggtggtgacggtgccaaaacagaaatcacttggtgggcattcccagtatttacccaagaaaaaactggtgacggtgttggaacttatgaaaaatcaatcatcgaagcgtttgaaaaagcaaacccagatataaaagtgaaattggaaaccatcgacttcaagtcaggtcctgaaaaaatcacaacagccatcgaagcaggaacagctccagacgtactctttgatgcaccaggacgtatcatccaatacggtaaaaacggtaaattggctgagttgaatgacctcttcacagatgaatttgttaaagatgtcaacaatgaaaacatcgtacaagcaagtaaagctggagacaaggcttatatgtatccgattagttctgccccattctacatggcaatgaacaagaaaatgttagaagatgctggagtagcaaaccttgtaaaagaaggttggacaactgatgattttgaaaaagtattgaaagcacttaaagacaagggttacacaccaggttcattgttcagttctggtcaagggggagaccaaggaacacgtgcctttatctctaacctttatagcggttctgtaacagatgaaaaagttagcaaatatacaactgatgatcctaaattcgtcaaaggtcttgaaaaagcaactagctggattaaagacaatttgatcaataatggttcacaatttgacggtggggcagatatccaaaactttgccaacggtcaaacatcttacacaatcctttgggcaccagctcaaaatggtatccaagctaaacttttagaagcaagtaaggtagaagtggtagaagtaccattcccatcagacgaaggtaagccagctcttgagtaccttgtaaacgggtttgcagtattcaacaataaagacgacaagaaagtcgctgcatctaagaaattcatccagtttatcgcagatgacaaggagtggggacctaaagacgtagttcgtacaggtgctttcccagtccgtacttcatttggaaaactttatgaagacaaacgcatggaaacaatcagcggctggactcaatactactcaccatactacaacactattgatggatttgctgaaatgagaacactttggttcccaatgttgcaatctgtatcaaatggtgacgaaaaaccagcagatgctttgaaagccttcactgaaaaagcgaacgaaacaatcaaaaaagctatgaaacaa

SEQ ID NO: 26 - protein, 420 aa
GNSGGSKDAAKSGGDGAKTEITWWAFPVFTQEKTGDGVGTYEKSIIEAFEKANPDIKVKLETIDFKSGPEKITTAIEAGTAPDVLFDAPGRIIQYGKNGKLAELNDLFTDEFVKDVNNENIVQASKAGDKAYMYPISSAPFYMAMNKKMLEDAGVANLVKEGWTTDDFEKVLKALKDKGYTPGSLFSSGQGGDQGTRAFISNLYSGSVTDEKVSKYTTDDPKFVKGLEKATSWIKDNLINNGSQFDGGADIQNFANGQTSYTILWAPAQNGIQAKLLEASKVEVVEVPFPSDEGKPALEYLVNGFAVFNNKDDKKVAASKKFIQFIADDKEWGPKDVVRTGAFPVRTSFGKLYEDKRMETISGWTQYYSPYYNTIDGFAEMRTLWFPMLQSVSNGDEKPADALKAFTEKANETIKKAMKQ

SEQ ID NO: 27 - DNA, 658 bp; double-stranded, linear
ttcacaagaaaaaacaaaaaatgaagatggagaaactaagacagaacagacagccaaagctgatggaacagtcggtagtaagtctcaaggagctgcccagaagaaagcagaagtggtcaataaaggtgattactacagcattcaagggaaatacgatgaaatcatcgtagccaacaaacactatccattgtctaaagactataatccaggggaaaatccaacagccaaggcagagttggtcaaactcatcaaagcgatgcaagaggcaggtttccctattagtgatcattacagtggttttagaagttatgaaactcagaccaagctctatcaagattatgtcaaccaagatggaaaggcagcagctgaccgttactctgcccgtcctggctatagcgaacaccagacaggcttggcctttgatgtgattgggactgatggtgatttggtgacagaagaaaaagcagcccaatggctcttggatcatgcagctgattatggctttgttgtccgttatctcaaaggcaaggaaaaggaaacaggctatatggctgaagaatggcacctgcgttatgtaggaaaagaagctaaagaaattgctgcaagtggtctcagtttggaagaatactatggctttgaaggcggagactacgtcgat

SEQ ID NO: 28 - protein, 219 aa
SQEKTKNEDGETKTEQTAKADGTVGSKSQGAAQKKAEVVNKGDYYSIQGKYDEIIVANKHYPLSKDYNPGENPTAKAELVKLIKAMQEAGFPISDHYSGFRSYETQTKLYQDYVNQDGKAAADRYSARPGYSEHQTGLAFDVIGTDGDLVTEEKAAQWLLDHAADYGFVVRYLKGKEKETGYMAEEWHLRYVGKEAKEIAASGLSLEEYYGFEGGDYVD

SEQ ID NO: 29 - DNA, 790 bp; double-stranded, linear
gaaaggtctgtggtcaaataatcttacctgcggttatgatgaaaaaataatcttggaaaatataaatataaaaatacctgaagaaaaaatatcagttattattgggtcaaatggttgtgggaaatcaacactcattaaaaccttgtctcgacttataaagccattagagggagaagtattgcttgataataaatcaattaattcttataaagaaaaagatttagcaaaacacatagctatattacctcaatctccaataatccctgaatcaataacagtagctgatcttgtaagccgtggtcgtttcccctacagaaagccttttaagagtcttggaaaagatgaccttgaaataataaacagatcaatggttaaggccaatgttgaagatctagcaaataacctagttgaagaactttctgggggtcaaaggcaaagagtatggatagctctagccctagcccaagatacaagtatcctacttttagatgagccaactacttacttggatatctcatatcaaatagaactattagacctcttgactgatctaaaccaaaaatataagacaaccatttgcatgattttgcacgatataaatctaacagcaagatacgctgattacctatttgcaattaaagaaggtaaacttgttgcagagggaaagcctgaagatatactaaatgataaactagttaaagatatctttaatcttgaagcaaaaattatacgtgaccctatttccaattcgcctctaatgattcctattggcaagcaccatgttaactct

SEQ ID NO: 30 - protein, 262 aa
KGLWSNNLTCGYDEKIILENINIKIPEEKISVIIGSNGCGKSTLIKTLSRLIKPLEGEVLLDNKSINSYKEKDLAKHIAILPQSPIIPESITVADLVSRGRFPYRKPFKSLGKDDLEIINRSMVKANVEDLANNLVEELSGGQRQRVWIALALAQDTSILLLDEPTTYLDISYQIELLDLLTDLNQKYKTTICMILHDINLTARYADYLFAIKEGKLVAEGKPEDILNDKLVKDIFNLEAKIIRDPISNSPLMIPIGKHHVS

SEQ ID NO: 31 - DNA, 781 bp; double-stranded, linear
aaactcagaaaagaaagcagacaatgcaacaactatcaaaatcgcaactgttaaccgtagcggttctgaagaaaaacgttgggacaaaatccaagaattggttaaaaaagacggaattaccttggaatttacagagttcacagactactcacaaccaaacaaagcaactgctgatggcgaagtagatttgaacgctttccaacactataacttcttgaacaactggaacaaagaaaacggaaaagaccttgtagcgattgcagatacttacatctctccaatccgcctttactcaggtttgaatggaagtgccaacaagtacactaaagtagaagacatcccagcaaacggagaaatcgctgtaccgaatgacgctacaaacgaaagccgtgcgctttatttgcttcaatcagctggcttgattaaattggatgtttctggaactgctcttgcaacagttgccaacatcaaagaaaatccaaagaacttgaaaatcactgaattggacgctagccaaacagctcgttcattgtcatcagttgacgctgccgttgtaaacaataccttcgttacagaagcaaaattggactacaagaaatcacttttcaaagaacaagctgatgaaaactcaaaacaatggtacaacatcattgttgcaaaaaaagattgggaaacatcacctaaggctgatgctatcaagaaagtaatcgcagcttaccacacagatgacgtgaaaaaagttatcgaagaatcatcagatggtttggatcaaccagtttgg

SEQ ID NO: 32 - protein, 260 aa
NSEKKADNATTIKIATVNRSGSEEKRWDKIQELVKKDGITLEFTEFTDYSQPNKATADGEVDLNAFQHYNFLNNWNKENGKDLVAIADTYISPIRLYSGLNGSANKYTKVEDIPANGEIAVPNDATNESRALYLLQSAGLIKLDVSGTALATVANIKENPKNLKITELDASQTARSLSSVDAAVVNNTFVTEAKLDYKKSLFKEQADENSKQWYNIIVAKKDWETSPKADAIKKVIAAYHTDDVKKVIEESSDGLDQPVW

SEQ ID NO: 33 - DNA, 640 bp; double-stranded, linear
ttcgaaagggtcagaaggtgcagaccttatcagcatgaaaggggatgtcattacagaacatcaattttatgagcaagtgaaaagcaacccttcagcccaacaagtcttgttaaatatgaccatccaaaaagtttttgaaaaacaatatggctcagagcttgatgataaagaggttgatgatactattgccgaagaaaaaaaacaatatggcgaaaactaccaacgtgtcttgtcacaagcaggtatgactcttgaaacacgtaaagctcaaattcgtacaagtaaattagttgagttggcagttaagaaggtagcagaagctgaattgacagatgaagcctataagaaagcctttgatgagtacactccagatgtaacggctcaaatcatccgtcttaataatgaagataaggccaaagaagttctcgaaaaagccaaggcagaaggtgctgattttgctcaattagccaaagataattcaactgatgaaaaaacaaaagaaaatggtggagaaattacctttgattctgcttcaacagaagtacctggagcaagtccaaaaaagccgcttttcgcttttagatgtgggatggtgtttctggatgtggattacagcaactggggcacaccaagcctacag

SEQ ID NO: 34 - protein, 213 aa
SKGSEGADLISMKGDVITEHQFYEQVKSNPSAQQVLLNMTIQKVFEKQYGSELDDKEVDDTIAEEKKQYGENYQRVLSQAGMTLETRKAQIRTSKLVELAVKKVAEAELTDEAYKKAFDEYTPDVTAQIIRLNNEDKAKEVLEKAKAEGADFAQLAKDNSTDEKTKENGGEITFDSASTEVPGASPKKPLFAFRCGMVFLDVDYSNWGTPSLQ

SEQ ID NO: 35 - DNA, 631 bp; double-stranded, linear
ggggatggcagcttttaaaaatcctaacaatcaatacaaagctattacaattgctcaaactctaggtgatgatgcttcttcagaggaattggctggtagatatggttctgctgttcagtgtacagaagtgactgcctcaaacctttcaacagttaaaactaaagctacggttgtagaaaaaccactgaaagattttagagcgtctacgtctgatcagtctggttgggtggaatctaatggtaaatggtatttctatgagtctggtgatgtgaagacaggttgggtgaaaacagatggtaaatggtactatttgaatgacttaggtgtcatgcagactggatttgtaaaattttctggtagctggtattacttgagcaattcaggtgctatgtttacaggctggggaacagatggtagcagatggttctactttgacggctcaggagctatgaagacaggctggtacaaggaaaatggcacttggtattaccttgacgaagcaggtatcatgaagacaggttggtttaaagtcggaccacactggtactatgcctacggttcaggagctttggctgtgagcacaacaacaccagatggttaccgtgtaaatggtaatggtgaatgggtaaac

SEQ ID NO: 36 - protein, 210 aa
GMAAFKNPNNQYKAITIAQTLGDDASSEELAGRYGSAVQCTEVTASNLSTVKTKATVVEKPLKDFRASTSDQSGWVESNGKWYFYESGDVKTGWVKTDGKWYYLNDLGVMQTGFVKFSGSWYYLSNSGAMFTGWGTDGSRWFYFDGSGAMKTGWYKENGTWYYLDEAGIMKTGWFKVGPHWYYAYGSGALAVSTTTPDGYRVNGNGEWVN

SEQ ID NO: 37 - DNA, 1360 bp; double-stranded, linear
agacgagcaaaaaattaagcaagcagaagcggaagttgagagtaaacaagctgaggctacaaggttaaaaaaaatcaagacagatcgtgaagaagcagaagaagaagctaaacgaagagcagatgctaaagagcaaggtaaaccaaaggggcgggcaaaacgaggagttcctggagagctagcaacacctgataaaaaagaaaatgatgcgaagtcttcagattctagcgtaggtgaagaaactcttccaagcccatccctgaaaccagaaaaaaaggtagcagaagctgagaagaaggttgaagaagctaagaaaaaagccgaggatcaaaaagaagaagatcgccgtaactacccaaccaatacttacaaaacgcttgaacttgaaattgctgagtccgatgtggaagttaaaaaagcggagcttgaactagtaaaagaggaagctaaggaacctcgaaacgaggaaaaagttaagcaagcaaaagcggaagttgagagtaaaaaagctgaggctacaaggttagaaaaaatcaagacagatcgtaaaaaagcagaagaagaagctaaacgaaaagcagcagaagaagataaagttaaagaaaaaccagctgaacaaccacaaccagcgccggctccaaaagcagaaaaaccagctccagctccaaaaccagagaatccagctgaacaaccaaaagcagaaaaaccagctgatcaacaagctgaagaagactatgctcgtagatcagaagaagaatataatcgcttgactcaacagcaaccgccaaaaactgaaaaaccagcacaaccatctactccaaaaacaggctggaaacaagaaaacggtatgtggtacttctacaatactgatggttcaatggcgacaggatggctccaaaacaatggctcatggtactacctcaacagcaatggcgctatggcgacaggatggctccaaaacaatggttcatggtactatctaaacgctaatggttcaatggcaacaggatggctccaaaacaatggttcatggtactacctaaacgctaatggttcaatggcgacaggatggctccaatacaatggctcatggtactacctaaacgctaatggttcaatggcgacaggatggctccaatacaatggctcatggtactacctaaacgctaatggtgatatggcgacaggttgggtgaaagatggagatacctggtactatcttgaagcatcaggtgctatgaaagcaagccaatggttcaaagtatcagataaatggtactatgtcaatggctcaggtgcccttgcagtcaacacaactgtagatggctatggagtcaatgccaatggtgaatgggtaaac

SEQ ID NO: 38 - protein, 453 aa
DEQKIKQAEAEVESKQAEATRLKKIKTDREEAEEEAKRRADAKEQGKPKGRAKRGVPGELATPDKKENDAKSSDSSVGEETLPSPSLKPEKKVAEAEKKVEEAKKKAEDQKEEDRRNYPTNTYKTLELEIAESDVEVKKAELELVKEEAKEPRNEEKVKQAKAEVESKKAEATRLEKIKTDRKKAEEEAKRKAAEEDKVKEKPAEQPQPAPAPKAEKPAPAPKPENPAEQPKAEKPADQQAEEDYARRSEEEYNRLTQQQPPKTEKPAQPSTPKTGWKQENGMWYFYNTDGSMATGWLQNNGSWYYLNSNGAMATGWLQNNGSWYYLNANGSMATGWLQNNGSWYYLNANGSMATGWLQYNGSWYYLNANGSMATGWLQYNGSWYYLNANGDMATGWVKDGDTWYYLEASGAMKASQWFKVSDKWYYVNGSGALAVNTTVDGYGVNANGEWVN

SEQ ID NO: 39 - DNA, 412 bp; double-stranded, linear
ctgtggtgaggaagaaactaaaaagactcaagcagcacaacagccaaaacaacaaacgactgtacaacaaattgctgttggaaaagatgctccagacttcacattgcaatccatggatggcaaagaagttaagttatctgattttaagggtaaaaaggtttacttgaagttttgggcttcatggtgtggtccatgcaagaaaagtatgccagagttgatggaactagcggcgaaaccagatcgtgatttcgaaattcttactgtcattgcaccaggaattcaaggtgaaaaaactgttgagcaattcccacaatggttccaggaacaaggatataaggatatcccagttctttatgataccaaagcaaccacttccaagcttatcaaattcgaagcattcctacagaatatt

SEQ ID NO: 40 - protein, 137 aa
CGEEETKKTQAAQQPKQQTTVQQIAVGKDAPDFTLQSMDGKEVKLSDFKGKKVYLKFWASWCGPCKKSMPELMELAAKPDRDFEILTVIAPGIQGEKTVEQFPQWFQEQGYKDIPVLYDTKATTSKLIKFEAFLQNI

SEQ ID NO: 41 - DNA, 1462 bp; double-stranded, linear
gacttttaacaataaaactattgaagagttgcacaatctccttgtctctaaggaaatttctgcaacagaattgacccaagcaacacttgaaaatatcaagtctcgtgaggaagccctcaattcatttgtcaccatcgctgaggagcaagctcttgttcaagctaaagccattgatgaagctggaattgatgctgacaatgtcctttcaggaattccacttgctgttaaggataacatctctacagacggtattctcacaactgctgcctcaaaaatgctctacaactatgagccaatctttgatgcgacagctgttgccaatgcaaaaaccaagggcatgattgtcgttggaaagaccaacatggacgaatttgctatgggtggttcaggtgaaacttcacactacggagcaactaaaaacgcttggaaccacagcaaggttcctggtgggtcatcaagtggttctgccgcagctgtagcctcaggacaagttcgcttgtcacttggttctgatactggtggttccatccgccaacctgctgccttcaacggaatcgttggtctcaaaccaacctacggaacagtttcacgtttcggtctcattgcctttggtagctcattagaccagattggaccttttgctcctactgttaaggaaaatgccctcttgctcaacgctattgccagcgaagatgctaaagactctacttctgctcctgtccgcatcgccgactttacttcaaaaatcggccaagacatcaagggtatgaaaatcgctttgcctaaggaatacctaggcgaaggaattgatccagaggttaaggaaacaatcttaaacgcggccaaacactttgaaaaattgggtgctatcgtcgaagaagtcagccttcctcactctaaatacggtgttgccgtttattacatcatcgcttcatcagaagcttcatcaaacttgcaacgcttcgacggtatccgttacggctatcgcgcagaagatgcaaccaaccttgatgaaatctatgtaaacagccgaagccaaggttttggtgaagaggtaaaacgtcgtatcatgctgggtactttcagtctttcatcaggttactatgatgcctactacaaaaaggctggtcaagtccgtaccctcatcattcaagatttcgaaaaagtcttcgcggattacgatttgattttgggtccaactgctccaagtgttgcctatgacttggattctctcaaccatgacccagttgccatgtacttagccgacctattgaccatacctgtaaacttggcaggactgcctggaatttcgattcctgctggattctctcaaggtctacctgtcggactccaattgattggtcccaagtactctgaggaaaccatttaccaagctgctgctgcttttgaagcaacaacagactaccacaaacaacaacccgtgatttttggaggtgacaac

SEQ ID NO: 42 - protein, 487 aa
TFNNKTIEELHNLLVSKEISATELTQATLENIKSREEALNSFVTIAEEQALVQAKAIDEAGIDADNVLSGIPLAVKDNISTDGILTTAASKMLYNYEPIFDATAVANAKTKGMIVVGKTNMDEFAMGGSGETSHYGATKNAWNHSKVPGGSSSGSAAAVASGQVRLSLGSDTGGSIRQPAAFNGIVGLKPTYGTVSRFGLIAFGSSLDQIGPFAPTVKENALLLNAIASEDAKDSTSAPVRIADFTSKIGQDIKGMKIALPKEYLGEGIDPEVKETILNAAKHFEKLGAIVEEVSLPHSKYGVAVYYIIASSEASSNLQRFDGIRYGYRAEDATNLDEIYVNSRSQGFGEEVKRRIMLGTFSLSSGYYDAYYKKAGQVRTLIIQDFEKVFADYDLILGPTAPSVAYDLDSLNHDPVAMYLADLLTIPVNLAGLPGISIPAGFSQGLPVGLQLIGPKYSEETIYQAAAAFEATTDYHKQQPVIFGGDN

SEQ ID NO: 43 - DNA, 433 bp; double-stranded, linear
ctttacaggtaaacaactacaagtcggcgacaaggcgcttgatttttctcttactacaacagatctttctaaaaaatctctggctgattttgatggcaagaaaaaagtcttgagtgtcgttccttctatcgatacaggcatctgctcaactcaaacacgtcgttttaatgaagaattggctggactggacaacacggtcgtattgactgtttcaatggacctaccttttgctcaaaaacgttggtgcggtgctgaaggccttgacaatgccattatgctttcagactactttgaccattctttcgggcgcgattatgccctcttgatcaacgaatggcacctattagcacgcgcagtctttgtcctcgatactgacaatacgattcgctacgttgaatacgtggataatatcaattctgagccaaacttcgaa

SEQ ID NO: 44 - protein, 144 aa
FTGKQLQVGDKALDFSLTTTDLSKKSLADFDGKKKVLSVVPSIDTGICSTQTRRFNEELAGLDNTVVLTVSMDLPFAQKRWCGAEGLDNAIMLSDYFDHSFGRDYALLINEWHLLARAVFVLDTDNTIRYVEYVDNINSEPNFE

SEQ ID NO: 45 - DNA, 724 bp; double-stranded, linear
ccaggctgatacaagtatcgcagacattcaaaaaagaggcgaactggttgtcggtgtcaaacaagacgttcccaattttggttacaangatcccaagaccggtacttattctggtatcgaaaccgacttggccaagatggtagctgatgaactcaaggtcaagattcgctatgtgccggttacagcacaaacccgcggcccccttctagacaatgaacaggtcgatatggatatcgcgacctttaccatcacggacgaacgcaaaaaactctacaactttaccagtccctactacacagacgcttctggatttttggtcaataaatctgccaaaatcaaaaagattgaggacctaaacggcaaaaccatcggagtcgcccaaggttctatcacccaacgcctgattactgaactgggtaaaaagaaaggtctgaagtttaaattcgtcgaacttggttcctacccagaattgattacttccctgcacgctcatcgtatcgataccttttccgttgaccgctctattctatctggctacactagtaaacggacagcactactagatgatagtttcaagccatctgactacggtattgttaccaagaaatcaaatacagagctcaacgactatcttgataacttggttactaaatggagcaaggatggtagtttgcagaaactttatgaccgttacaagctcaaaccatctagccatactgcagat

SEQ ID NO: 46 - protein, 241 aa
QADTSIADIQKRGELVVGVKQDVPNFGYXDPKTGTYSGIETDLAKMVADELKVKIRYVPVTAQTRGPLLDNEQVDMDIATFTITDERKKLYNFTSPYYTDASGFLVNKSAKIKKIEDLNGKTIGVAQGSITQRLITELGKKKGLKFKFVELGSYPELITSLHAHRIDTFSVDRSILSGYTSKRTALLDDSFKPSDYGIVTKKSNTELNDYLDNLVTKWSKDGSLQKLYDRYKLKPSSHTAD

SEQ ID NO: 47 - DNA, 1279 bp; double-stranded, linear
gtctgtatcatttgaaaacaaagaaacaaaccgtggtgtcttgactttcactatctctcaagaccaaatcaaaccagaattggaccgtgtcttcaagtcagtgaagaaatctcttaatgttccaggtttccgtaaaggtcaccttccacgccctatcttcgaccaaaaatttggtgaagaagctctttatcaagatgcaatgaacgcacttttgccaaacgcttatgaagcagctgtaaaagaagctggtcttgaagtggttgcccaaccaaaaattgacgtaacttcaatggaaaaaggtcaagactgggttatcactgctgaagtcgttacaaaacctgaagtaaaattgggtgactacaaaaaccttgaagtatcagttgatgtagaaaaagaagtaactgacgctgatgtcgaagagcgtatcgaacgcgaacgcaacaacctggctgaattggttatcaaggaagctgctgctgaaaacggcgacactgttgtgatcgacttcgttggttctatcgacggtgttgaatttgacggtggaaaaggtgaaaacttctcacttggacttggttcaggtcaattcatccctggtttcgaagaccaattggtaggtcactcagctggcgaaaccgttgatgttatcgtaacattcccagaagactaccaagcagaagaccttgcaggtaaagaagctaaattcgtgacaactatccacgaagtaaaagctaaagaagttccggctcttgacgatgaacttgcaaaagacattgatgaagaagttgaaacacttgctgacttgaaagaaaaatacagcaaagaattggctgctgctaaagaagaagcttacaaagatgcagttgaaggtgcagcaattgatacagctgtagaaaatgctgaaatcgtagaacttccagaagaaatgatccatgaagaagttcaccgttcagtaaatgaattccttgggaatttgcaacgtcaagggatcaaccctgacatgtacttccaaatcactggaactactcaagaagaccttcacaaccaataccaagcagaagctgagtcacgtactaagactaaccttgttatcgaagcagttgccaaagctgaaggatttgatgcttcagaagaagaaatccaaaaagaagttgagcaattggcagcagactacaacatggaagttgcacaagttcaaaacttgctttcagctgacatgttgaaacatgatatcactatcaaaaaagctgttgaattgatcacaagcacagcaacagtaaaa

SEQ ID NO: 48 - protein, 426 aa
SVSFENKETNRGVLTFTISQDQIKPELDRVFKSVKKSLNVPGFRKGHLPRPIFDQKFGEEALYQDAMNALLPNAYEAAVKEAGLEVVAQPKIDVTSMEKGQDWVITAEVVTKPEVKLGDYKNLEVSVDVEKEVTDADVEERIERERNNLAELVIKEAAAENGDTVVIDFVGSIDGVEFDGGKGENFSLGLGSGQFIPGFEDQLVGHSAGETVDVIVTFPEDYQAEDLAGKEAKFVTTIHEVKAKEVPALDDELAKDIDEEVETLADLKEKYSKELAAAKEEAYKDAVEGAAIDTAVENAEIVELPEEMIHEEVHRSVNEFLGNLQRQGINPDMYFQITGTTQEDLHNQYQAEAESRTKTNLVIEAVAKAEGFDASEEEIQKEVEQLAADYNMEVAQVQNLLSADMLKHDITIKKAVELITSTATVK

SEQ ID NO: 49 - DNA, 490 bp; double-stranded, linear
tggtcaaaaggaaagtcagacaggaaaggggatgaaaattgtgaccagtttttatcctatctacgctatggttaaggaagtatctggtgacttgaatgatgttcggatgattcagtcaagtagtggtattcactcctttgaaccttcggcaaatgatatcgcagccatctatgatgcagatgtctttgtttaccattctcatacactcgaatcttgggcaggaagtctggatccaaatctaaaaaaatccaaagtgaaggtcttagaggcttctgagggaatgaccttggaacgtgtccctggactagaggatgtggaagcaggggatggagttgatgaaaaaacgctctatgaccctcacacatggctagatcctgaaaaagctggagaagaagcccaaattatcgctgataaactttcagaggtggatagtgagcataaagagacttatcaaaaaaatgcgcaacctttatcaaaaaagctcaggaat

SEQ ID NO: 50 - protein, 163 aa
GQKESQTGKGMKIVTSFYPIYAMVKEVSGDLNDVRMIQSSSGIHSFEPSANDIAAIYDADVFVYHSHTLESWAGSLDPNLKKSKVKVLEASEGMTLERVPGLEDVEAGDGVDEKTLYDPHTWLDPEKAGEEAQIIADKLSEVDSEHKETYQKNAQPLSKKLRN

SEQ ID NO: 51 - DNA, 1006 bp; double-stranded, linear
gaaggatagatatattttagcatttgagacatcctgtgatgagaccagtgtcgccgtcttgaaaaacgacgatgagctcttgtccaatgtcattgctagtcaaattgagagtcacaaacgttttggtggcgtagtgcccgaagtagccagtcgtcaccatgtcgaggtcattacagcctgtatcgaggaggcattggcagaagcagggattaccgaagaggacgtgacagctgttgcggttacctacggaccaggcttggtcggagccttgctagttggtttgtcagctgccaaggcctttgcttgggctcacggacttccactgattcctgttaatcacatggctgggcacctcatggcagctcagagtgtggagcctttggagtttcccttgctagccctcttggtcagcggcggacacacagagttggtttatgtttcggaggcaggagattataagattgttggggaaacccgtgatgatgcggttggtgaggcttatgataaggtcggccgtgtcatgggcttgacctatcctgcaggtcgtgagattgacgagctggctcatcaggggcaggatatttatgatttcccccgtgccatgattaaggaagataatctggagttctccttctcaggtttgaaatctgcctttatcaatcttcatcacaatgccgagcaaaagggagaaagcctgtctacagaagatttgtgtgcttccttccaagcagcagttatggacattctcatggcaaaaaccaagaaggctttggagaaatatcctgttaaaatcctagttgtggcaggtggtgtggcagccaataaaggtctcagagaacgcctagcagccgaaatcacagatgtcaaggttatcatcccccctctgcgactctgcggagacaatgcaggtatgattgcctatgccagcgtcagcnagtggaacaaagaaaacttcgcaggctgggacctcaatgccaaaccaagtcttgcctttgataccatggaa

SEQ ID NO: 52 - protein, 335 aa
KDRYILAFETSCDETSVAVLKNDDELLSNVIASQIESHKRFGGVVPEVASRHHVEVITACIEEALAEAGITEEDVTAVAVTYGPGLVGALLVGLSAAKAFAWAHGLPLIPVNHMAGHLMAAQSVEPLEFPLLALLVSGGHTELVYVSEAGDYKIVGETRDDAVGEAYDKVGRVMGLTYPAGREIDELAHQGQDIYDFPRAMIKEDNLEFSFSGLKSAFINLHHNAEQKGESLSTEDLCASFQAAVMDILMAKTKKALEKYPVKILVVAGGVAANKGLRERLAAEITDVKVIIPPLRLCGDNAGMIAYASVSXWNKENFAGWDLNAKPSLAFDTME

SEQ ID NO: 53 - DNA, 1000 bp; double-stranded, linear
ggtagttaaagttggtattaacggtttcggacgtatcggtcgtcttgctttccgtcgtatccaaaacgtagaaggtgttgaagttacacgcatcaacgaccttacagatccagttatgcttgcacacttgttgaaatacgacacaactcaaggtcgtttcgacggtactgttgaagttaaagaaggtggatttgaagttaacggtaaattcatcaaagtttctgctgaacgtgatccagaacaaatcgactgggctactgacggtgtagaaatcgttcttgaagctactggtttctttgctaagaaagaagcagctgaaaaacaccttaaaggtggagctaaaaaagttgttatcactgctcctggtggaaacgacgttaaaacagttgtattcaacactaaccacgacgttcttgacggtactgaaacagttatctcaggtgcttcatgtactacaaactgcttggctccaatggctaaagctcttcaagacaactttggtgttgttgaaggattgatgactactatccacgcttacactggtgaccaaatgatccttgacggaccacaccgtggtggtgaccttcgccgtgctcgcgctggtgctgcaaacatcgttcctaactcaactggtgctgcaaaagctatcggtcttgtaatcccagaattgaatggtaaacttgacggatctgcacaacgcgttccaactccaactggatcagttactgaattggtagcagttcttgaaaagaacgttactgttgatgaagtgaacgcagctatgaaagcagcttcaaacgaatcatacggttacacagaagatccaatcgtatcttcagatatcgtaggtatgtcttacggttcattgtttgacgcaactcaaactaaagttcttgacgttgacggtaaacaattggttaaagttgtatcatggtacgacaacgaaatgtcatacactgcacaacttgttcgtactcttggaatacttcgcaaaaattgc

SEQ ID NO: 54 - protein, 333 aa
VVKVGINGFGRIGRLAFRRIQNVEGVEVTRINDLTDPVMLAHLLKYDTTQGRFDGTVEVKEGGFEVNGKFIKVSAERDPEQIDWATDGVEIVLEATGFFAKKEAAEKHLKGGAKKVVITAPGGNDVKTVVFNTNHDVLDGTETVISGASCTTNCLAPMAKALQDNFGVVEGLMTTIHAYTGDQMILDGPHRGGDLRRARAGAANIVPNSTGAAKAIGLVIPELNGKLDGSAQRVPTPTGSVTELVAVLEKNVTVDEVNAAMKAASNESYGYTEDPIVSSDIVGMSYGSLFDATQTKVLDVDGKQLVKVVSWYDNEMSYTAQLVRTLGILRKNC

SEQ ID NO: 55 - DNA, 2389 bp; double-stranded, linear
ttcttacgagttgggactgtatcaagctagaacggttaaggaaaataatcgtgtttcctatatagatggaaaacaagcgacgcaaaaaacggagaatttgactcctgatgaggttagcaagcgtgaaggaatcaatgctgagcaaatcgtcatcaagataacagaccaaggctatgtcacttcacatggcgaccactatcattattacaatggtaaggttccttatgacgctatcatcagtgaagaattactcatgaaagatccaaactataagctaaaagatgaggatattgttaatgaggtcaagggtggatatgttatcaaggtagatggaaaatactatgtttaccttaaggatgctgcccacgcggataacgtccgtacaaaagaggaaatcaatcgacaaaaacaagagcatagtcaacatcgtgaaggtggaactccaagaaacgatggtgctgttgccttggcacgttcgcaaggacgctatactacagatgatggttatatctttaatgcttctgatatcatagaggatactggtgatgcttatatcgttcctcatggagatcattaccattacattcctaagaatgagttatcagctagcgagttggctgctgcagaagccttcctatctggtcgaggaaatctgtcaaattcaagaacctatcgccgacaaaatagcgataacacttcaagaacaaactgggtaccttctgtaagcaatccaggaactacaaatactaacacaagcaacaacagcaacactaacagtcaagcaagtcaaagtaatgacattgatagtctcttgaaacagctctacaaactgcctttgagtcaacgacatgtagaatctgatggccttgtctttgatccagcacaaatcacaagtcgaacagctagaggtgttgcagtgccacacggagatcattaccacttcatcccttactctcaaatgtctgaattggaagaacgaatcgctcgtattattccccttcgttatcgttcaaaccattgggtaccagattcaaggccagaacaaccaagtccacaaccgactccggaacctagtccaggcccgcaacctgcaccaaatcttaaaatagactcaaattcttctttggttagtcagctggtacgaaaagttggggaaggatatgtattcgaagaaaagggcatctctcgttatgtctttgcgaaagatttaccatctgaaactgttaaaaatcttgaaagcaagttatcaaaacaagagagtgtttcacacactttaactgctaaaaaagaaaatgttgctcctcgtgaccaagaattttatgataaagcatataatctgttaactgaggctcataaagccttgtttgnaaataagggtcgtaattctgatttccaagccttagacaaattattagaacgcttgaatgatgaatcgactaataaagaaaaattggtagatgatttattggcattcctagcaccaattacccatccagagcgacttggcaaaccaaattctcaaattgagtatactgaagacgaagttcgtattgctcaattagctgataagtatacaacgtcagatggttacatttttgatgaacatgatataatcagtgatgaaggagatgcatatgtaacgcctcatatgggccatagtcactggattggaaaagatagcctttctgataaggaaaaagttgcagctcaagcctatactaaagaaaaaggtatcctacctccatctccagacgcagatgttaaagcaaatccaactggagatagtgcagcagctatttacaatcgtgtgaaaggggaaaaacgaattccactcgttcgacttccatatatggttgagcatacagttgaggttaaaaacggtaatttgattattcctcataaggatcattaccataatattaaatttgcttggtttgatgatcacacatacaaagctccaaatggctataccttggaagatttgtttgcgacgattaagtactacgtagaacaccctgacgaacgtccacattctaatgatggatggggcaatgccagtgagcatgtgttaggcaagaaagaccacagtgaagatccaaataagaacttcaaagcggatgaagagccagtagaggaaacacctgctgagccagaagtccctcaagtagagactgaaaaagtagaagcccaactcaaagaagcagaagttttgcttgcgaaagtaacggattctagtctgaaagccaatgcaacagaaactctagctggtttacgaaataatttgactcttcaaattatggataacaatagtatcatggcagaagcagaaaaattacttgcgttgttaaaaggaagtaatccttcatctgtaagtaaggaaaaaataaac

SEQ ID NO: 56 - protein, 796 aa
SYELGLYQARTVKENNRVSYIDGKQATQKTENLTPDEVSKREGINAEQIVIKITDQGYVTSHGDHYHYYNGKVPYDAIISEELLMKDPNYKLKDEDIVNEVKGGYVIKVDGKYYVYLKDAAHADNVRTKEEINRQKQEHSQHREGGTPRNDGAVALARSQGRYTTDDGYIFNASDIIEDTGDAYIVPHGDHYHYIPKNELSASELAAAEAFLSGRGNLSNSRTYRRQNSDNTSRTNWVPSVSNPGTTNTNTSNNSNTNSQASQSNDIDSLLKQLYKLPLSQRHVESDGLVFDPAQITSRTARGVAVPHGDHYHFIPYSQMSELEERIARIIPLRYRSNHWVPDSRPEQPSPQPTPEPSPGPQPAPNLKIDSNSSLVSQLVRKVGEGYVFEEKGISRYVFAKDLPSETVKNLESKLSKQESVSHTLTAKKENVAPRDQEFYDKAYNLLTEAHKALFXNKGRNSDFQALDKLLERLNDESTNKEKLVDDLLAFLAPITHPERLGKPNSQIEYTEDEVRIAQLADKYTTSDGYIFDEHDIISDEGDAYVTPHMGHSHWIGKDSLSDKEKVAAQAYTKEKGILPPSPDADVKANPTGDSAAAIYNRVKGEKRIPLVRLPYMVEHTVEVKNGNLIIPHKDHYHNIKFAWFDDHTYKAPNGYTLEDLFATIKYYVEHPDERPHSNDGWGNASEHVLGKKDHSEDPNKNFKADEEPVEETPAEPEVPQVETEKVEAQLKEAEVLLAKVTDSSLKANATETLAGLRNNLTLQIMDNNSIMAEAEKLLALLKGSNPSSVSKEKIN

SEQ ID NO: 57 - DNA, 1180 bp; double-stranded, linear
tactgagatgcatcataatctaggagctgaaaagcgttcagcagtggctactactatcgatagttttaaggagcgaagtcaaaaagtcagagcactatctgatccaaatgtgcgttttgttcccttctttggctctagtgaatggcttcgttttgacggtgctcattctgcggtattagctgagaaatacaatcgttcctaccgtccttatcttttaggacaggggggagctgcatcgcttaaccaatattttggaatgcaacagatgttaccacagctggagaataaacaagttgtgtatgttatctcacctcagtggttcagtaaaaatggctatgatccagcagccttccagcagtattttaatggagaccagttgactagttttctgaaacatcaatctggggatcaggctagtcaatatgcagcgactcgcttactgcaacagttcccaaacgtagctatgaaggacctggttcagaagttggcaagtaaagaagaattgtcgacagcagacaatgaaatgattgaattattggctcgttttaatgaacgccaagcttccttttttggtcagttttcggttagaggctatgttaactacgataagcatgtagctaagtatttaaaaatcttgccagaccagttttcttatcaggcaatagaagatgttgtcaaagcagatgctgaaaaaaatacttccaataatgagatgggaatggaaaattatttctataatgagcagatcaagaaggatttgaagaaattaaaggattctcagaaaagctttacctatctcaagtcgccagagtataatgnnttgcagttggttttaacacagttttctaaatctaaggtaaacccgatttttatcattccacctgttaataaaaaatggatgnactatgctggtctacgagaggatatgtaccaacaaacggtgcagaagattcgctaccagttagaaagtcaaggttttaccaatatagcagatttttctaaggacggcggggagcctttctttatgaaggacaccattcaccttggttggttgggttggttggcttttgacaaggcagttgatcctttcctatccaatcccacaccagctccgacttaccatctgaatgagcgctttttcagcaaagattgggcgacttatgatggagatgtcaaagaa

SEQ ID NO: 58 - protein, 393 aa
TEMHHNLGAEKRSAVATTIDSFKERSQKVRALSDPNVRFVPFFGSSEWLRFDGAHSAVLAEKYNRSYRPYLLGQGGAASLNQYFGMQQMLPQLENKQVVYVISPQWFSKNGYDPAAFQQYFNGDQLTSFLKHQSGDQASQYAATRLLQQFPNVAMKDLVQKLASKEELSTADNEMIELLARFNERQASFFGQFSVRGYVNYDKHVAKYLKILPDQFSYQAIEDVVKADAEKNTSNNEMGMENYFYNEQIKKDLKKLKDSQKSFTYLKSPEYNXLQLVLTQFSKSKVNPIFIIPPVNKKWMXYAGLREDMYQQTVQKIRYQLESQGFTNIADFSKDGGEPFFMKDTIHLGWLGWLAFDKAVDPFLSNPTPAPTYHLNERFFSKDWATYDGDVKE

SEQ ID NO: 59 - DNA, 1423 bp; double-stranded, linear
ggttttgagaaagtatttgcagggggccctgattgagtcgattgagcaagtggaaaatgaccgtattgtggaaattacagtttccaataaaaacgagattggagaccatatccaggctaccttgattatcgaaattatggggaaacacagtaatattctactggtcgataaaagcagtcataaaatcctcgaagttatcaaacacgtcggcttttcacaaaatagctaccgcaccttacttccaggatcgacctatatcgctccgccaagtacaaaatctctcaatccttttactatcaaggatgaaaagctctttgaaatcctgcaaacccaagaactaacagcaaaaaatcttcaaagcctctttcaaggtctgggacgcgatacggcaaatgaattggaaaggatactggttagtgaaaaactttccgctttccgaaattttttcaatcaagaaaccaagccatgcttgactgagacttccttcagtccagttccttttgcaaatcaggtgggagagccttttgcaaatctttctgatttgttggacacctactataaggataaggctgagcgcgaccgcgtcaaacagcaggccagtgaactgattcgtcgtgttgaaaatgaacttcagaaaaaccgacacaaactcaaaaaacaggaaaaagagttactggcgacagacaacgctgaagaatttcgtcaaaaaggagaattgctgacaaccttcctccaccaagtgcctaacgaccaagaccaggttatcctagacaactactataccaaccaacctatcatgattgcgcttgataaggctctgactcccaaccagaatgcccaacgctattttaaacggtatcagaaactcaaagaagctgtcaaatacttgactgatttgattgaagaaaccaaagccactattctctatctggaaagtgtagaaaccgtcctcaaccaagctggactggaagaaatcgctgaaatccgtgaagaattgattcaaacaggttttatccgcagaagacaacgggagaaaatccagaaacgcaaaaaactagaacaatatctagcaagcgatggcaaaaccatcatctatgtcggacgaaacaatcttcaaaatgaggaattgacctttaaaatggcccgcaaggaggaactttggttccatgctaaggacattcctggaagccatgttgtcatctcaggaaatcttgacccatctgatgcagtcaagacagacgcagcagagttagctgcctacttctctcaagggcgcctgtcgaatctggtgcaggtagatatgattgaagtcaaaaaactcaataaaccaactggtggaaaacccggctttgtcacttacacaggacaaaagaccctccgcgtcacaccagactccaaaaaaattgcatccatgaaaaaatcc

SEQ ID NO: 60 - protein, 474 aa
VLRKYLQGALIESIEQVENDRIVEITVSNKNEIGDHIQATLIIEIMGKHSNILLVDKSSHKILEVIKHVGFSQNSYRTLLPGSTYIAPPSTKSLNPFTIKDEKLFEILQTQELTAKNLQSLFQGLGRDTANELERILVSEKLSAFRNFFNQETKPCLTETSFSPVPFANQVGEPFANLSDLLDTYYKDKAERDRVKQQASELIRRVENELQKNRHKLKKQEKELLATDNAEEFRQKGELLTTFLHQVPNDQDQVILDNYYTNQPIMIALDKALTPNQNAQRYFKRYQKLKEAVKYLTDLIEETKATILYLESVETVLNQAGLEEIAEIREELIQTGFIRRRQREKIQKRKKLEQYLASDGKTIIYVGRNNLQNEELTFKMARKEELWFHAKDIPGSHVVISGNLDPSDAVKTDAAELAAYFSQGRLSNLVQVDMIEVKKLNKPTGGKPGFVTYTGQKTLRVTPDSKKIASMKKS

SEQ ID NO: 61 - DNA, 544 bp; double-stranded, linear
gacaacatttactatccatacagtagagtcagcaccagcagaagtgaaagaaattcttgaaacagtagaaaaagacaacaatggctatattcccaacctaatcggtctcttggccaatgccccgactgttttagaagcctaccaaattgtctcatctatccaccgtcgcaacagcctgacacccgttgagcgtgaagtggtgcaaatcacggcagccgtgaccaatggttgtgccttctgtgtcgcaggtcacacagccttttccatcaaacaaatccagatgaatgatgacttgattcaagctcttcgcaatcgtactccaattgaaacagatcctaaattggataccctagctaagtttaccttggcagttatcaataccaagggtcgtgtaggagatgaagccttgtctgagtttttagaagctggctacactcaacaaaatgccttggatgtggtttttggtgtcagcctagcaatcctctgtaactatgccaacaacttagctaatacaccaattaatccagaattgcaaccttatgcc

SEQ ID NO: 62 - protein, 181 aa
TTFTIHTVESAPAEVKEILETVEKDNNGYIPNLIGLLANAPTVLEAYQIVSSIHRRNSLTPVEREVVQITAAVTNGCAFCVAGHTAFSIKQIQMNDDLIQALRNRTPIETDPKLDTLAKFTLAVINTKGRVGDEALSEFLEAGYTQQNALDVVFGVSLAILCNYANNLANTPINPELQPYA

SEQ ID NO: 63 - DNA, 811 bp; double-stranded, linear
ggctaaggaaagagtggatgtactagcttataaacaggggttgtttgaaacgagagagcaggccaagcgaggtgtgatggctggcctagtcgtagcagtccttaatggagaacggtttgacaagccaggagagaaaattccagatgacaccgaattaaaactcaagggggagaaactcaagtatgtcagccgtggtggtttgaaactggaaaaggccttgcaggtctttgatttgtcggtggatggcgcgactacgattgatatcggggcctctactggaggttttaccgatgtcatgctacagaatagtgccaagttggtctttgcagtcgatgttggtaccaatcagttggcttggaaattacgccaagacccacgagttgtcagcatggagcagttcaatttccgctatgctgaaaagactgatttcgagcaggagccgagctttgccagtattgatgtgagtttcatttcccttagtctgattttgccagccttgcaccgtgtcttggctgatcaaggtcaggtggtagcacttgtcaaacctcagtttgaggcaggacgtgagcagattgggaaaaatggaattattcgagatgctaaggttcatcagaatgtccttgaatctgtaacagctatggcagtagaggtaggtttttcagtccttggcttggacttttctcccatccaaggtggacatggaaatattgaatttttagcgtatttgaaaaaagaaaagtcagcaagcaatcagattcttgctgagattaaagaagcagtagagagggcgcatagtcaatttaaaaatgaa

SEQ ID NO: 64 - protein, 270 aa
AKERVDVLAYKQGLFETREQAKRGVMAGLVVAVLNGERFDKPGEKIPDDTELKLKGEKLKYVSRGGLKLEKALQVFDLSVDGATTIDIGASTGGFTDVMLQNSAKLVFAVDVGTNQLAWKLRQDPRVVSMEQFNFRYAEKTDFEQEPSFASIDVSFISLSLILPALHRVLADQGQVVALVKPQFEAGREQIGKNGIIRDAKVHQNVLESVTAMAVEVGFSVLGLDFSPIQGGHGNIEFLAYLKKEKSASNQILAEIKEAVERAHSQFKNE

SEQ ID NO: 65 - DNA, 2290 bp; double-stranded, linear
ttgttcctatgaacttggtcgtcaccaagctggtcaggttaagaaagagtctaatcgagtttcttatatagatggtgatcaggctggtcaaaaggcagaaaacttgacaccagatgaagtcagtaagagggaggggatcaacgccgaacaaatngtnatcaagattacggatcaaggttatgtgacctctcatggagaccattatcattactataatggcaaggttccttatgatgccatcatcagtgaagagctcctcatgaaagatccgaattatcagttgaaggattcagacattgtcaatgaaatcaagggtggttatgtcattaaggtaaacggtaaatactatgtntaccttaaggatgcagctcatgcggataatattcggacaaaagaagagattaaacgtcagaagcaggaacgcagtcataatcataactcaagagcagataatgctgttgctgcagccagagcccaaggacgttatacaacggatgatgggtatatcttcaatgcatctgatatcattgaggacacgggtgatgcttatatcgttcctcacggcgaccattaccattacattcctaagaatgagttatcagctagcgagttagctgctgcagaagcctattggaatgggaagcagggatctcgtccttcttcaagttctagttataatgcaaatccagctcaaccaagattgtcagagaaccacaatctgactgtcactccaacttatcatcaaaatcaaggggaaaacatttcaagccttttacgtgaattgtatgctaaacccttatcagaacgccatgtggaatctgatggccttattttcgacccagcgcaaatcacaagtcgaaccgccagaggtgtagctgtccctcatggtaaccattaccactttatcccttatgaacaaatgtctgaattggaaaaacgaattgctcgtattattccccttcgttatcgttcaaaccattgggtaccagattcaagaccagaacaaccaagtccacaatcgactccggaacctagtccaagtccgcaacctgcaccaaatcctcaaccagctccaagcaatccaattgatgagaaattggtcaaagaagctgttcgaaaagtaggcgatggttatgtctttgaggagaatggagtttctcgttatatcccagccaaggatctttcagcagaaacagcagcaggcattgatagcaaactggccaagcaggaaagtttatctcataagctaggagctaagaaaactgacctcccatctagtgatcgagaattttacaataaggcttatgacttactagcaagaattcaccaagatttacttgataataaaggtcgacaagttgattttgaggctttggataacctgttggaacgactcaaggatgtcncaagtgataaagtcaagttagtggangatattcttgccttcttagctccgattcgtcatccagaacgtttaggaaaaccaaatgcgcaaattacctacactgatgatgagattcaagtagccaagttggcaggcaagtacacaacagaagacggttatatctttgatcctcgtgatataaccagtgatgagggggatgcctatgtaactccacatatgacccatagccactggattaaaaaagatagtttgtctgaagctgagagagcggcagcccaggcttatgctaaagagaaaggtttgacccctccttcgacagaccatcaggattcaggaaatactgaggcaaaaggagcagaagctatctacaaccgcgtgaaagcagctaagaaggtgccacttgatcgtatgccttacaatcttcaatatactgtagaagtcaaaaacggtagtttaatcatacctcattatgaccattaccataacatcaaatttgagtggtttgacgaaggcctttatgaggcacctaaggggtatactcttgaggatcttttggcgactgtcaagtactatgtcgaacatccaaacgaacgtccgcattcagataatggttttggtaacgctagcgaccatgttcaaagaaacaaaaatggtcaagctgataccaatcaaacggaaaaaccaagcgaggagaaacctcagacagaaaaacctgaggaagaaacccctcgagaagagaaaccgcaaagcgagaaaccagagtctccaaaaccaacagaggaaccagaagaatcaccagaggaatcagaagaacctcaggtcgagactgaaaaggttgaagaaaaactgagagaggctgaagatttacttggaaaaatccaggat

SEQ ID NO: 66 - protein, 763 aa
CSYELGRHQAGQVKKESNRVSYIDGDQAGQKAENLTPDEVSKREGINAEQXVIKITDQGYVTSHGDHYHYYNGKVPYDAIISEELLMKDPNYQLKDSDIVNEIKGGYVIKVNGKYYVYLKDAAHADNIRTKEEIKRQKQERSHNHNSRADNAVAAARAQGRYTTDDGYIFNASDIIEDTGDAYIVPHGDHYHYIPKNELSASELAAAEAYWNGKQGSRPSSSSSYNANPAQPRLSENHNLTVTPTYHQNQGENISSLLRELYAKPLSERHVESDGLIFDPAQITSRTARGVAVPHGNHYHFIPYEQMSELEKRIARIIPLRYRSNHWVPDSRPEQPSPQSTPEPSPSPQPAPNPQPAPSNPIDEKLVKEAVRKVGDGYVFEENGVSRYIPAKDLSAETAAGIDSKLAKQESLSHKLGAKKTDLPSSDREFYNKAYDLLARIHQDLLDNKGRQVDFEALDNLLERLKDVXSDKVKLVXDILAFLAPIRHPERLGKPNAQITYTDDEIQVAKLAGKYTTEDGYIFDPRDITSDEGDAYVTPHMTHSHWIKKDSLSEAERAAAQAYAKEKGLTPPSTDHQDSGNTEAKGAEAIYNRVKAAKKVPLDRMPYNLQYTVEVKNGSLIIPHYDHYHNIKFEWFDEGLYEAPKGYTLEDLLATVKYYVEHPNERPHSDNGFGNASDHVQRNKNGQADTNQTEKPSEEKPQTEKPEEETPREEKPQSEKPESPKPTEEPEESPEESEEPQVETEKVEEKLREAEDLLGKIQD

SEQ ID NO: 67 - DNA, 352 bp; double-stranded, linear
ttataagggtgaattagaaaaaggataccaatttgatggttgggaaatttctggtttcgaaggtaaaaaagacgctggctatgttattaatctatcaaaagatacctttataaaacctgtattcaagaaaatagaggagaaaaaggaggaagaaaataaacctacttttgatgtatcgaaaaagaaagataacccacaagtaaaccatagtcaattaaatgaaagtcacagaaaagaggatttacaaagagaagagcattcacaaaaatctgattcaactaaggatgttacagctacagttcttgataaaaacaatatcagtagtaaatcaactactaacaatcctaataag

SEQ ID NO: 68 - protein, 117 aa
YKGELEKGYQFDGWEISGFEGKKDAGYVINLSKDTFIKPVFKKIEEKKEEENKPTFDVSKKKDNPQVNHSQLNESHRKEDLQREEHSQKSDSTKDVTATVLDKNNISSKSTTNNPNK

SEQ ID NO: 69 - DNA, 1312 bp; double-stranded, linear
gaatgttcaggctcaagaaagttcaggaaataaaatccactttatcaatgttcaagaaggtggcagtgatgcgattattcttgaaagcaatggacattttgccatggtggatacaggagaagattatgatttcccagatggaagtgattctcgctatccatggagagaaggaattgaaacgtcttataagcatgttctaacagaccgtgtctttcgtcgtttgaaggaattgggtgtccaaaaacttgattttattttggtgacccatacccacagtgatcatattggaaatgttgatgaattactgtctacctatccagttgaccgagtctatcttaagaaatatagtgatagtcgtattactaattctgaacgtctatgggataatctgtatggctatgataaggttttacagactgctgcagaaaaaggtgtttcagttattcaaaatatcacacaaggggatgctcattttcagtttggggacatggatattcagctctataattatgaaaatgaaactgattcatcgggtgaattaaagaaaatttgggatgacaattccaattccttgattagcgtggtgaaagtcaatggcaagaaaatttaccttgggggcgatttagataatgttcatggagcagaagacaagtatggtcctctcattggaaaagttgatttgatgaagtttaatcatcaccatgataccaacaaatcaaataccaaggatttcattaaaaatttgagtccgagtttgattgttcaaacttcggatagtctaccttggaaaaatggtgttgatagtgagtatgttaattggctcaaagaacgaggaattgagagaatcaacgcagccagcaaagactatgatgcaacagtttttgatattcgaaaagacggttttgtcaatatttcaacatcctacaagccgattccaagttttcaagctggttggcataagagtgcatatgggaactggtggtatcaagcgcctgattctacaggagagtatgctgtcggttggaatgaaatcgaaggtgaatggtattactttaaccaaacgggtatcttgttacagaatcaatggaaaaaatggaacaatcattggttctatttgacagactctggtgcttctgctaaaaattggaagaaaatcgctggaatctggtattattttaacaaagaaaaccagatggaaattggttggattcaagataaagagcagtggtattatttggatgttgatggttctatgaagacaggatggcttcaatatatggggcaatggtattactttgctccatcaggggaa

SEQ ID NO: 70 - protein, 437 aa
NVQAQESSGNKIHFINVQEGGSDAIILESNGHFAMVDTGEDYDFPDGSDSRYPWREGIETSYKHVLTDRVFRRLKELGVQKLDFILVTHTHSDHIGNVDELLSTYPVDRVYLKKYSDSRITNSERLWDNLYGYDKVLQTAAEKGVSVIQNITQGDAHFQFGDMDIQLYNYENETDSSGELKKIWDDNSNSLISVVKVNGKKIYLGGDLDNVHGAEDKYGPLIGKVDLMKFNHHHDTNKSNTKDFIKNLSPSLIVQTSDSLPWKNGVDSEYVNWLKERGIERINAASKDYDATVFDIRKDGFVNISTSYKPIPSFQAGWHKSAYGNWWYQAPDSTGEYAVGWNEIEGEWYYFNQTGILLQNQWKKWNNHWFYLTDSGASAKNWKKIAGIWYYFNKENQMEIGWIQDKEQWYYLDVDGSMKTGWLQYMGQWYYFAPSGE

SEQ ID NO: 71 - DNA, 1855 bp; double-stranded, linear
cttgggtgtaacccatatccagctccttccagtcttgtcttactactttgtcaatgaattgaaaaaccatgaacgcttgtctgactacgcttcaagcaacagcaactacaactggggatatgaccctcaaaactacttctccttgactggtatgtactcaagcgatcctaagaatccagaaaaacgaatcgcagaatttaaaaacctcatcaacgaaatccacaaacgtggtatgggagctatcctagatgtcgtttataaccacacagccaaagtcgatctctttgaagatttggaaccaaactactaccactttatggatgccgatggcacacctcgaactagctttggtggtggacgcttggggacaacccaccatatgaccaaacggctcctaattgactctatcaaatacctagttgatacctacaaagtggatggcttccgtttcgatatgatgggagaccatgacgccgcttctatcgaagaagcttacaaggctgcacgcgccctcaatccaaacctcatcatgcttggtgaaggttggagaacctatgccggtgatgaaaacatgcctactaaagctgctgaccaagattggatgaaacataccgatactgtcgctgtcttttcagatgacatccgtaacaacctcaaatctggttatccaaacgaaggtcaacctgcctttatcacaggtggcaagcgtgatgtcaacaccatctttaaaaatctcattgctcaaccaactaactttgaagctgacagccctggagatgtcatccaatacatcgcagcccatgataacttgaccctctttgacatcattgcccagtctatcaaaaaagacccaagcaaggctgagaactatgctgaaatccaccgtcgtttacgacttggaaatctcatggtcttgacagctcaaggaactccatttatccactccggtcaggaatatggacgtactaaacaattccgtgacccagcctacaagactccagtagcagaggataaggttccaaacaaatctcacttgttgcgtgataaggacggcaacccatttgactatccttacttcatccatgactcttacgattctagtgatgcagtcaacaagtttgactggactaaggctacagatggtaaagcttatcctgaaaatgtcaagagccgtgactatatgaaaggtttgattgcccttcgtcaatctacagatgccttccgacttaagagtcttcaagatatcaaagaccgtgtccacctcatcactgtcccaggccaaaatggtgtggaaaaagaggatgtagtgattggctaccaaatcactgctccaaacggcgatatctacgcagtctttgtcaatgcggatgaaaaagctcgcgaatttaatttgggaactgcctttgcacatctaagaaatgcggaagttttggcagatgaaaaccaagcaggaccagtcggaattgccaacccgaaaggacttgaatggactgaaaaaggcttgaaattgaatgcccttacagctactgttcttcgagtctctcaaaatggaactagccatgagtcaactgcagaagagaaaccagactcaaccccttccaagcctgaacatcaaaatgaagcttctcaccctgcacatcaagacccagctccagaagctagacctgattctactaaaccagatgccaaagtagctgatgcggaaaataaacctagccaagctacagctgattcacaagctgaacaaccagcacaagaagcacaagcatcatctgtaaaagaagcggttcgaaacgaatcggtagaaaactctagcaaggaaaatatacctgcaaccccagataaacaagctgaa

SEQ ID NO: 72 - protein, 618 aa
LGVTHIQLLPVLSYYFVNELKNHERLSDYASSNSNYNWGYDPQNYFSLTGMYSSDPKNPEKRIAEFKNLINEIHKRGMGAILDVVYNHTAKVDLFEDLEPNYYHFMDADGTPRTSFGGGRLGTTHHMTKRLLIDSIKYLVDTYKVDGFRFDMMGDHDAASIEEAYKAARALNPNLIMLGEGWRTYAGDENMPTKAADQDWMKHTDTVAVFSDDIRNNLKSGYPNEGQPAFITGGKRDVNTIFKNLIAQPTNFEADSPGDVIQYIAAHDNLTLFDIIAQSIKKDPSKAENYAEIHRRLRLGNLMVLTAQGTPFIHSGQEYGRTKQFRDPAYKTPVAEDKVPNKSHLLRDKDGNPFDYPYFIHDSYDSSDAVNKFDWTKATDGKAYPENVKSRDYMKGLIALRQSTDAFRLKSLQDIKDRVHLITVPGQNGVEKEDVVIGYQITAPNGDIYAVFVNADEKAREFNLGTAFAHLRNAEVLADENQAGPVGIANPKGLEWTEKGLKLNALTATVLRVSQNGTSHESTAEEKPDSTPSKPEHQNEASHPAHQDPAPEARPDSTKPDAKVADAENKPSQATADSQAEQPAQEAQASSVKEAVRNESVENSSKENIPATPDKQAE

SEQ ID NO: 73 - DNA, 1774 bp; double-stranded, linear
tagtgatggtacttggcaaggaaaacagtatctgaaagaagatggcagtcaagcagcaaatgagtgggttttngatactcattatcaatcttggttctatataaaagcagatgctaactatgctgaaaatgaatggctaaagcaaggtgacgactatttttacctcaaatctggtggctatatggccaaatcagaatgggtagaagacaagggagccttttattatcttgaccaagatggaaagatgaaaagaaatgcttgggtaggaacttcctatgttggtgcaacaggtgccaaagtaatagaagactgggtctatgattctcaatacgatgcttggttttatatcaaagcagatggacagcacgcagagaaagaatggctccaaattaaagggaaggactattatttcaaatccggtggttatctactgacaagtcagtggattaatcaagcttatgtgaatgctagtggtgccaaagtacagcaaggttggctttttgacaaacaataccaatcttggttttacatcaaagaaaatggaaactatgctgataaagaatggattttcgagaatggtcactattattatctaaaatccggtggctacatggcagccaatgaatggatttgggataaggaatcttggttttatctcaaatttgatgggaaaatggctgaaaaagaatgggtctacgattctcatagtcaagcttggtactacttcaaatccggtggttacatgacagccaatgaatggatttgggataaggaatcttggttttacctcaaatctgatgggaaaatagctgaaaaagaatgggtctacgattctcatagtcaagcttggtactacttcaaatctggtggctacatggcgaaaaatgagacagtagatggttatcagcttggaagcgatggtaaatggcttggaggaaaaactacaaatgaaaatgctgcttactatcaagtagtgcctgttacagccaatgtttatgattcagatggtgaaaagctttcctatatatcgcaaggtagtgtcgtatggctagataaggatagaaaaagtgatgacaagcgcttggctattactatttctggtttgtcaggctatatgaaaacagaagatttacaagcgctagatgctagtaaggactttatcccttattatgagagtgatggccaccgtttttatcactatgtggctcagaatgctagtatcccagtagcttctcatctttctgatatggaagtaggcaagaaatattattcggcagatggcctgcattttgatggttttaagcttgagaatcccttccttttcaaagatttaacagaggctacaaactacagtgctgaagaattggataaggtatttagtttgctaaacattaacaatagccttttggagaacaagggcgctacttttaaggaagccgaagaacattaccatatcaatgctctttatctccttgcccatagtgccctagaaagtaactggggaagaagtaaaattgccaaagataagaataatttctttggcattacagcctatgatacgaccccttacctttctgctaagacatttgatgatgtggataagggaattttaggtgcaaccaagtggattaaggaaaattatatcgataggggaagaactttccttggaaacaaggcttctggtatgaatgtggaatatgcttcagacccttattggggcgaaaaaattgctagtgtgatgatgaaaatcaatgagaagctaggtggcaaagat

SEQ ID NO: 74 - protein, 591 aa
SDGTWQGKQYLKEDGSQAANEWVXDTHYQSWFYIKADANYAENEWLKQGDDYFYLKSGGYMAKSEWVEDKGAFYYLDQDGKMKRNAWVGTSYVGATGAKVIEDWVYDSQYDAWFYIKADGQHAEKEWLQIKGKDYYFKSGGYLLTSQWINQAYVNASGAKVQQGWLFDKQYQSWFYIKENGNYADKEWIFENGHYYYLKSGGYMAANEWIWDKESWFYLKFDGKMAEKEWVYDSHSQAWYYFKSGGYMTANEWIWDKESWFYLKSDGKIAEKEWVYDSHSQAWYYFKSGGYMAKNETVDGYQLGSDGKWLGGKTTNENAAYYQVVPVTANVYDSDGEKLSYISQGSVVWLDKDRKSDDKRLAITISGLSGYMKTEDLQALDASKDFIPYYESDGHRFYHYVAQNASIPVASHLSDMEVGKKYYSADGLHFDGFKLENPFLFKDLTEATNYSAEELDKVFSLLNINNSLLENKGATFKEAEEHYHINALYLLAHSALESNWGRSKIAKDKNNFFGITAYDTTPYLSAKTFDDVDKGILGATKWIKENYIDRGRTFLGNKASGMNVEYASDPYWGEKIASVMMKINEKLGGKD

SEQ ID NO: 75 - DNA, 1105 bp; double-stranded, linear
tgggattcaatatgtcagagatgatactagagataaagaagagggaatagagtatgatgacgctgacaatggggatattattgtaaaagtagcgactaaacctaaggtagtaaccaagaaaatttcaagtacgcgaattcgttatgaaaaagatgaaacaaaagaccgtagtgaaaatcctgttacaattgatggagaggatggctatgtaactacgacaaggacctacgatgttaatccagagactggttatgttaccgaacaggttactgttgatagaaaagaagccacggatacagttatcaaagttccagctaaaagcaaggttgaagaagttcttgttccatttgctactaaatatgaagcagacaatgacctttctgcaggacaggagcaagagattactctaggaaagaatgggaaaacagttacaacgataacttataatgtagatggaaagagtggacaagtaactgagagtactttaagtcaaaaaaaagactctcaaacaagagttgttaaaaaaagaaccarkccccaagttcttgtccaagaaattccaatcgaaacagaatatctcgatggcccaactcttgataaaagtcaagaagtagaagaagtaggagaaattggtaaattactcttactacaatctatactggtagatgaacgtgatggaacaattgaagaaactacttctcgtcaaattactaaagagatggtaaaaagacgtataaggagagggacgagagaacctgaaaaagttgttgttcctgagcaatcatctattccttcgtatcctgtatctgttacatctaaccaaggaacagatgtagcagtagaaccagctaaagcagttgctccaacaacagactggaaacaagaaaatggtatgtggtatttttataatactgatggttccatggcaacaggttgggtacaagttaatagttcatggtactacctcaacagcaacggttctatgaaagtcaatcaatggttccaagttggtggtaaatggtattatgtaaatacatcgggtgagttagcggtcaatacaagtatagatggctatagagtcaatgataatggtgaatgggtgcgt

SEQ ID NO: 76 - protein, 368 aa
GIQYVRDDTRDKEEGIEYDDADNGDIIVKVATKPKVVTKKISSTRIRYEKDETKDRSENPVTIDGEDGYVTTTRTYDVNPETGYVTEQVTVDRKEATDTVIKVPAKSKVEEVLVPFATKYEADNDLSAGQEQEITLGKNGKTVTTITYNVDGKSGQVTESTLSQKKDSQTRVVKKRTXPQVLVQEIPIETEYLDGPTLDKSQEVEEVGEIGKLLLLQSILVDERDGTIEETTSRQITKEMVKRRIRRGTREPEKVVVPEQSSIPSYPVSVTSNQGTDVAVEPAKAVAPTTDWKQENGMWYFYNTDGSMATGWVQVNSSWYYLNSNGSMKVNQWFQVGGKWYYVNTSGELAVNTSIDGYRVNDNGEWVR

SEQ ID NO: 77 - DNA, 661 bp; double-stranded, linear
ggataatagagaagcattaaaaacctttatgacgggtgaaaatttttatctccaacattatctaggagcacatagggaagaactaaatggagagcatggctataccttccgtgtttgggcacctaatgctcaggctgttcacttggttggtgattttaccaactggattgaaaatcagattccaatggtaagaaatgattttggggtctgggaagtctttaccaatatggctcaagaagggcatatttacaaatatcatgtcacacgtcaaaatggtcatcaactgatgaagattgacccttttgctgtcaggtatgaggctcgtccaggaacaggggcaatcgtaacagagcttcctgagaagaaatggaaggatggactttggctggcacgaagaaaacgttggggctttgaagagcgtcctgtcaatatttatgaagttcacgctggatcatggaaaagaaattctgatggcagtccttatagttttgcccagctcaaggatgaactcattccttatctcgttgaaatgaactatactcatattgagtttatgcccttgatgtcccatcctttgggcttgagttgggggtatcagcttatgggttacttcgctttagagcatgcttatggccgaccagaggagtttcaagattttgtc

SEQ ID NO: 78 - protein, 220 aa
DNREALKTFMTGENFYLQHYLGAHREELNGEHGYTFRVWAPNAQAVHLVGDFTNWIENQIPMVRNDFGVWEVFTNMAQEGHIYKYHVTRQNGHQLMKIDPFAVRYEARPGTGAIVTELPEKKWKDGLWLARRKRWGFEERPVNIYEVHAGSWKRNSDGSPYSFAQLKDELIPYLVEMNYTHIEFMPLMSHPLGLSWGYQLMGYFALEHAYGRPEEFQDFV

SEQ ID NO: 79 - DNA, 976 bp; double-stranded, linear
agattttgtcgaggagtgtcatacccataatattggggttattgtggactgggtaccagntcactttaccatcaacgatgatgccttagcctattatgatgggacaccgacttttgaataccaagaccataataaggctcataaccatggttggggtgcccttaattttgaccttggaaaaaatgaagtccagtccttcttaatttcttgcattaagcattggattgatgtctatcatttggatggtattcgtgtggatgctgttagcaacatgctctatttggactatgatgatgctccatggacacctaataaagatggcggaaatctcaactatgaaggttattatttccttcagcgcttgaatgaggttattaagttagaatatccagatgtgatgatgattgcagaagaaagttcgtctgcgatcaagattacgggaatgaaagagattggtggtctaggatttgactacaaatggaacatgggctggatgaatgatatcctccgtttctacgaagaagatccgatctatcgtaaatatgactttaacctggtgactttcagctttatgtatgtttncaaggagaattatctcttgccattctcgcacgatgaagtggttcatggcaagaagagtatgatgcataagatgtggggagatcgttacaatcaattcgcaggcttgcgcaatctctatacgtaccaaatttgtcaccctggtaagaaattgctcttcatgggtagcgaatacggtcaattcctagaatggaaatctgaagaacagttggaatggtctaacctagaagacccaatgaatgctaagatgaagtatttcgcttctcagctaaaccagttttacaaagatcatcgctgtctgtgggaaattgataccagctatgatggtattgaaatcattgatgcggataatcgagaccagagtgttctttcctttattcgtaagggtaaaaaggga

SEQ ID NO: 80 - protein, 325 aa
DFVEECHTHNIGVIVDWVPXHFTINDDALAYYDGTPTFEYQDHNKAHNHGWGALNFDLGKNEVQSFLISCIKHWIDVYHLDGIRVDAVSNMLYLDYDDAPWTPNKDGGNLNYEGYYFLQRLNEVIKLEYPDVMMIAEESSSAIKITGMKEIGGLGFDYKWNMGWMNDILRFYEEDPIYRKYDFNLVTFSFMYVXKENYLLPFSHDEVVHGKKSMMHKMWGDRYNQFAGLRNLYTYQICHPGKKLLFMGSEYGQFLEWKSEEQLEWSNLEDPMNAKMKYFASQLNQFYKDHRCLWEIDTSYDGIEIIDADNRDQSVLSFIRKGKKG

SEQ ID NO: 81 - DNA, 2134 bp; double-stranded, linear
atctgtagtttatgcggatgaaacacttattactcatactgctgagaaacctaaagaggaaaaaatgatagtagaagaaaaggctgataaagctttggaaactaaaaatatagttgaaaggacagaacaaagtgaacctagttcaactgaggctattgcatctgagnagaaagaagatgaagccgtaactccaaaagaggaaaaagtgtctgctaaaccggaagaaaaagctccaaggatagaatcacaagcttcaaatcaagaaaaaccgctcaaggaagatgctaaagctgtaacaaatgaagaagtgaatcaaatgattgaagacaggaaagtggattttaatcaaaattggtactttaaactcaatgcaaattctaaggaagccattaaacctgatgcagacgtatctacgtggaaaaaattagatttaccgtatgactggagtatctttaacgatttcgatcatgaatctcctgcacaaaatgaaggtggacagctcaacggtggggaagcttggtatcgcaagactttcaaactagatgaaaaagacctcaagaaaaatgttcgccttacttttgatggcgtctacatggattctcaagtttatgtcaatggtcagttagtggggcattatccaaatggttataaccagttctcatatgatatcaccaaataccttcaaaaagatggtcgtgagaatgtgattgctgtccatgcagtcaacaaacagccaagtagccgttggtattcaggaagtggtatctatcgtgatgtgactttacaagtgacagataaggtgcatgttgagaaaaatgggacaactattttaacaccaaaacttgaagaacaacaacatggcaaggttgaaactcatgtgaccagcaaaatcgtcaatacggacgacaaagaccatgaacttgtagccgaatatcaaatcgttgaacgaggtggtcatgctgtaacaggcttagttcgtacagcgagtcgtaccttaaaagcacatgaatcaacaagcctagatgcgattttagaagttgaaagaccaaaactctggactgttttaaatgacaaacctgccttgtacgaattgattacgcgtgtttaccgtgacggtcaattggttgatgctaagaaggatttgtttggttaccgttactatcactggactccaaatgaaggtttctctttgaatggtgaacgtattaaattccatggagtatccttgcaccacgaccatggggcgcttggagcagaagaaaactataaagcagaatatcgccgtctcaaacaaatgaaggagatgggagttaactccatccgtacaacccacaaccctgctagtgagcaaaccttgcaaatcgcagcagaactaggtttactcgttcaggaagaggcctttgatacgtggtatggtggcaagaaaccttatgactatggacgtttctttgaaaaagatgccactcacccagaagctcgaaaaggtgaaaaatggtctgattttgacctacgtaccatggtcgaaagaggcaaaaacaaccctgctatcttcatgtggtcaattggtaatgaaataggtgaagctaatggtgatgcccactctttagcaactgttaaacgtttggttaaggttatcaaggatgttgataagactcgctatgttaccatgggagcagataaattccgtttcggtaatggtagcggagggcatgagaaaattgctgatgaactcgatgctgttggatttaactattctgaagataattacaaagcccttagagctaagcatccaaaatggttgatttatggatcagaaacatcttcagctacccgtacacgtggaagttactatcgccctgaacgtgaattgaaacatagcaatggacctgagcgtaattatgaacagtcagattatggaaatgatcgtgtgggttgggggaaaacagcaaccgcttcatggacttttgaccgtgacaacgctggctatgctggacagtttatctggacaggtacggactatattggtgaacctacaccatggcacaaccaaaatcaaactcctgttaagagctcttactttggtatcgtagatacagccggcattccaaaacatgacttctatctctaccaaagc

SEQ ID NO: 82 - protein, 711 aa
SVVYADETLITHTAEKPKEEKMIVEEKADKALETKNIVERTEQSEPSSTEAIASEXKEDEAVTPKEEKVSAKPEEKAPRIESQASNQEKPLKEDAKAVTNEEVNQMIEDRKVDFNQNWYFKLNANSKEAIKPDADVSTWKKLDLPYDWSIFNDFDHESPAQNEGGQLNGGEAWYRKTFKLDEKDLKKNVRLTFDGVYMDSQVYVNGQLVGHYPNGYNQFSYDITKYLQKDGRENVIAVHAVNKQPSSRWYSGSGIYRDVTLQVTDKVHVEKNGTTILTPKLEEQQHGKVETHVTSKIVNTDDKDHELVAEYQIVERGGHAVTGLVRTASRTLKAHESTSLDAILEVERPKLWTVLNDKPALYELITRVYRDGQLVDAKKDLFGYRYYHWTPNEGFSLNGERIKFHGVSLHHDHGALGAEENYKAEYRRLKQMKEMGVNSIRTTHNPASEQTLQIAAELGLLVQEEAFDTWYGGKKPYDYGRFFEKDATHPEARKGEKWSDFDLRTMVERGKNNPAIFMWSIGNEIGEANGDAHSLATVKRLVKVIKDVDKTRYVTMGADKFRFGNGSGGHEKIADELDAVGFNYSEDNYKALRAKHPKWLIYGSETSSATRTRGSYYRPERELKHSNGPERNYEQSDYGNDRVGWGKTATASWTFDRDNAGYAGQFIWTGTDYIGEPTPWHNQNQTPVKSSYFGIVDTAGIPKHDFYLYQS

SEQ ID NO: 83 - DNA, 2167 bp; double-stranded, linear
ttactttggtatcgtagatacagccggcattccaaaacatgacttctatctctaccaaagccaatgggtttctgttaagaagaaaccgatggtacaccttcttcctcactggaactgggaaaacaaagaattagcatccaaagtagctgactcagaaggtaagattccagttcgtgcttattcgaatgcttctagtgtagaattgttcttgaatggaaaatctcttggtcttaagactttcaataaaaaacaaaccagcgatgggcggacttaccaagaaggtgcaaatgctaatgaactttatcttgaatggaaagttgcctatcaaccaggtaccttggaagcaattgctcgtgatgaatctggcaaggaaattgctcgagataagattacgactgctggtaagccagcggcagttcgtcttattaaggaagaccatgcgattgcagcagatggaaaagacttgacttacatctactatgaaattgttgacagccaggggaatgtggttccaactgctaataatctggttcgcttccaattgcatggccaaggtcaactggtcggtgtagataacggagaacaagccagccgtgaacgctataaggcgcaagcagatggttcttggattcgtaaagcatttaatggtaaaggtgttgccattgtcaaatcaactgaacaagcagggaaattcaccctgactgcccactctgatctcttgaaatcgaaccaagtcactgtctttactggtaagaaagaaggacaagagaagactgttttggggacagaagtgccaaaagtacagaccattattggagaggcacctgaaatgcctaccactgttccgtttgtatacagtgatggtagccgtgcagaacgtcctgtaacctggtcttcagtagatgtgagcaagcctggtattgtaacggtgaaaggtatggctgacggacgagaagtagaagctcgtgtagaagtgattgctcttaaatcagagctaccagttgtgaaacgtattgctccaaatactgacttgaattctgtagacaaatctgtttcctatgttttgattgatggaagtgttgaagagtatgaagtggacaagtgggagattgccgaagaagataaagctaagttagcaattccaggttctcgtattcaagcgaccggttatttagaaggtcaaccaattcatgcaacccttgtggtagaagaaggcaatcctgcggcacctgcagtaccaactgtaacggttggtggtgaggcagtaacaggtcttactagtcaaaaaccaatgcaataccgcactcttgcttatggagctaagttgccagaagtcacagcaagtgctaaaaatgcagctgttacagttcttcaagcaagcgcagcaaacggcatgcgtgcgagcatctttattcagcctaaagatggtggccctcttcaaacctatgcaattcaattccttgaagaagcgccaaaaattgctcacttgagcttgcaagtggaaaaagctgacagtctcaaagaagaccaaactgtcaaattgtcggttcgagctcactatcaagatggaacgcaagctgtattaccagctgataaagtaaccttctctacaagtggtgaaggggaagtcgcaattcgtaaaggaatgcttgagttgcataagccaggagcagtcactctgaacgctgaatatgagggagctaaagaccaagttgaactcactatccaagccaatactgagaagaagattgcgcaatccatccgtcctgtaaatgtagtgacagatttgcatcaggaaccaagtcttccagcaacagtaacagttgagtatgacaaaggtttccctaaaactcataaagtcacttggcaagctattccgaaagaaaaactagactcctatcaaacatttgaagtactaggtaaagttgaaggaattgaccttgaagcgcgtgcaaaagtctctgtagaaggtatcgtttcagttgaagaagtcagtgtgacaactccaatcgcagaagcaccacaattaccagaaagtgttcggacatatgattcaaatggtcacgtttcatcagctaaggttgcatgggatgcgattcgtccagagcaatacgctaaggaaggtgtctttacagttaatggtcgcttagaaggtacgcaattaaca

SEQ ID NO: 84 - protein, 722 aa
YFGIVDTAGIPKHDFYLYQSQWVSVKKKPMVHLLPHWNWENKELASKVADSEGKIPVRAYSNASSVELFLNGKSLGLKTFNKKQTSDGRTYQEGANANELYLEWKVAYQPGTLEAIARDESGKEIARDKITTAGKPAAVRLIKEDHAIAADGKDLTYIYYEIVDSQGNVVPTANNLVRFQLHGQGQLVGVDNGEQASRERYKAQADGSWIRKAFNGKGVAIVKSTEQAGKFTLTAHSDLLKSNQVTVFTGKKEGQEKTVLGTEVPKVQTIIGEAPEMPTTVPFVYSDGSRAERPVTWSSVDVSKPGIVTVKGMADGREVEARVEVIALKSELPVVKRIAPNTDLNSVDKSVSYVLIDGSVEEYEVDKWEIAEEDKAKLAIPGSRIQATGYLEGQPIHATLVVEEGNPAAPAVPTVTVGGEAVTGLTSQKPMQYRTLAYGAKLPEVTASAKNAAVTVLQASAANGMRASIFIQPKDGGPLQTYAIQFLEEAPKIAHLSLQVEKADSLKEDQTVKLSVRAHYQDGTQAVLPADKVTFSTSGEGEVAIRKGMLELHKPGAVTLNAEYEGAKDQVELTIQANTEKKIAQSIRPVNVVTDLHQEPSLPATVTVEYDKGFPKTHKVTWQAIPKEKLDSYQTFEVLGKVEGIDLEARAKVSVEGIVSVEEVSVTTPIAEAPQLPESVRTYDSNGHVSSAKVAWDAIRPEQYAKEGVFTVNGRLEGTQLT

SEQ ID NO: 85 - DNA, 2329 bp; double-stranded, linear
agctaaggttgcatgggatgcgattcgtccagagcaatacgctaaggaaggtgtctttacagttaatggtcgcttagaaggtacgcaattaacaactaaacttcatgttcgcgtatctgctcaaactgagcaaggtgcaaacatttctgaccaatggaccggttcagaattgccacttgcctttgcttcagactcaaatccaagcgacccagtttcaaatgttaatgacaagctcatttcctacaataaccaaccagccaatcgttggacaaactggaatcgtactaatccagaagcttcagtcggtgttctgtttggagattcaggtatcttgagcaaacgctccgttgataatctaagtgtcggattccatgaagaccatggagttggtgtaccgaagtcttatgtgattgagtattatgttggtaagactgtcccaacagctcctaaaaaccctagttttgttggtaatgaggaccatgtctttaatgattctgccaactggaaaccagttactaatctaaaagcccctgctcaactcaaggctggagaaatgaaccactttagctttgataaagttgaaacctatgctgttcgtattcgcatggttaaagcagataacaagcgtggaacgtctatcacagaggtacaaatctttgcgaaacaagttgcggcagccaagcaaggacaaacaagaatccaagttgacggcaaagacttagcaaacttcaaccctgatttgacagactactaccttgagtctgtagatggaaaagttccggcagtcacagcaagtgttagcaacaatggtctcgctaccgtcgttccaagcgttcgtgaaggtgagccagttcgtgtcatcgcgaaagctgaaaatggcgacatcttaggagaataccgtctgcacttcactaaggataagagcttactttctcataaaccagttgctgcggttaaacaagctcgcttgctacaagtaggtcaagcacttgaattgccgactaaggttccagtttacttcacaggtaaagacggctacgaaacaaaagacctgacagttgaatgggaagaagttccagcggaaaatctgacaaaagcaggtcaatttactgttcgaggccgtgtccttggtagtaaccttgttgctgagatcactgtacgagtgacagacaaacttggtgagactctttcagataaccctaactatgatgaaaacagtaaccaggcctttgcttcagcaaccaatgatattgacaaaaactctcatgaccgcgttgactatctcaatgacggagatcattcagaaaatcgtcgttggacaaactggtcaccaacaccatcttctaatccagaagtatcagcgggtgtgattttccgtgaaaatggtaagattgtagaacggactgttacacaaggaaaagttcagttctttgcagatagtggtacggatgcaccatctaaactcgttttagaacgctatgtcggtccagagtttgaagtgccaacctactattcaaactaccaagcctacgacgcagaccatccattcaacaatccagaaaattgggaagctgttccttatcgtgcggataaagacattgcagctggtgatgaaatcaacgtaacatttaaagctatcaaagccaaagctatgagatggcgtatggagcgtaaagcagataagagcggtgttgcgatgattgagatgaccttccttgcaccaagtgaattgcctcaagaaagcactcaatcaaagattcttgtagatggaaaagaacttgctgatttcgctgaaaatcgtcaagactatcaaattacctataaaggtcaacggccaaaagtctcagttgaagaaaacaatcaagtagcttcaactgtggtagatagtggagaagatagctttccagtacttgttcgcctcgtttcagaaagtggaaaacaagtcaaggaataccgtatccacttgactaaggaaaaaccagtttctgagaagacagttgctgctgtacaagaagatcttccaaaaatcgaatttgttgaaaaagatttggcatacaagacagttgagaaaaaagattcaacactgtatctaggtgaaactcgtgtagaacaagaaggaaaagttggaaaagaacgtatctttacagcgattaatcctgatggaagtaaggaagaaaaactccgtgaagtggtagaagttccgacagaccgcatcgtcttggttggaaccaaaccagtagctcaagaagctaaaaaaccacaagtgtcagaaaaagcagatacaaaaccaattgattcaagtgaagctagtcaaactaataaagcccag

SEQ ID NO: 86 - protein, 776 aa
AKVAWDAIRPEQYAKEGVFTVNGRLEGTQLTTKLHVRVSAQTEQGANISDQWTGSELPLAFASDSNPSDPVSNVNDKLISYNNQPANRWTNWNRTNPEASVGVLFGDSGILSKRSVDNLSVGFHEDHGVGVPKSYVIEYYVGKTVPTAPKNPSFVGNEDHVFNDSANWKPVTNLKAPAQLKAGEMNHFSFDKVETYAVRIRMVKADNKRGTSITEVQIFAKQVAAAKQGQTRIQVDGKDLANFNPDLTDYYLESVDGKVPAVTASVSNNGLATVVPSVREGEPVRVIAKAENGDILGEYRLHFTKDKSLLSHKPVAAVKQARLLQVGQALELPTKVPVYFTGKDGYETKDLTVEWEEVPAENLTKAGQFTVRGRVLGSNLVAEITVRVTDKLGETLSDNPNYDENSNQAFASATNDIDKNSHDRVDYLNDGDHSENRRWTNWSPTPSSNPEVSAGVIFRENGKIVERTVTQGKVQFFADSGTDAPSKLVLERYVGPEFEVPTYYSNYQAYDADHPFNNPENWEAVPYRADKDIAAGDEINVTFKAIKAKAMRWRMERKADKSGVAMIEMTFLAPSELPQESTQSKILVDGKELADFAENRQDYQITYKGQRPKVSVEENNQVASTVVDSGEDSFPVLVRLVSESGKQVKEYRIHLTKEKPVSEKTVAAVQEDLPKIEFVEKDLAYKTVEKKDSTLYLGETRVEQEGKVGKERIFTAINPDGSKEEKLREVVEVPTDRIVLVGTKPVAQEAKKPQVSEKADTKPIDSSEASQTNKAQ

SEQ ID NO: 87 - DNA, 133 bp; double-stranded, linear
ctatcactatgtaaataaagagattatttcacaagaagctaaagatttaattcagacaggaaagcctgacaggaatgaagttgtatatggtttggtgtatcaaaaagatcagttgcctcaaacagggacagaa

SEQ ID NO: 88 - protein, 44 aa
YHYVNKEIISQEAKDLIQTGKPDRNEVVYGLVYQKDQLPQTGTE

SEQ ID NO: 89 - DNA, 775 bp; double-stranded, linear
tgagactcctcaatcaataacaaatcaggagcaagctaggacagaaaaccaagtagtagagacagaggaagctccaaaagaagaagcacctaaaacagaagaaagtccaaaggaagaaccaaaatcggaggtaaaacctactgacgacacccttcctaaagtagaagaggggaaagaagattcagcagaaccagctccagttgaagaagtaggtggagaagttgagtcaaaaccagaggaaaaagtagcagttaagccagaaagtcaaccatcagacaaaccagctgaggaatcaaaagttgaacaagcaggtgaaccagtcgcgccaagagaagacgaaaaggcaccagtcgagccagaaaagcaaccagaagctcctgaagaagagaaggctgtagaggaaacaccgaaacaagaagagtcaactccagataccaaggctgaagaaactgtagaaccaaaagaggagactgttaatcaatctattgaacaaccaaaagttgaaacgcctgctgtagaaaaacaaacagaaccaacagaggaaccaaaagttgaacaagcaggtgaaccagtcgcgccaagagaagacgaacaggcaccaacggcaccagttgagccagaaaagcaaccagaagttcctgaagaagagaaggctgtagaggaaacaccgaaaccagaagataaaataaagggtattggtactaaagaaccagttgataaaagtgagttaaataatcaaattgataaagctagttcagtttctcctactgattat

SEQ ID NO: 90 - protein, 258 aa
ETPQSITNQEQARTENQVVETEEAPKEEAPKTEESPKEEPKSEVKPTDDTLPKVEEGKEDSAEPAPVEEVGGEVESKPEEKVAVKPESQPSDKPAEESKVEQAGEPVAPREDEKAPVEPEKQPEAPEEEKAVEETPKQEESTPDTKAEETVEPKEETVNQSIEQPKVETPAVEKQTEPTEEPKVEQAGEPVAPREDEQAPTAPVEPEKQPEVPEEEKAVEETPKPEDKIKGIGTKEPVDKSELNNQIDKASSVSPTDY

SEQ ID NO: 91 - DNA, 199 bp; double-stranded, linear
ggatgctcaagaaactgcgggagttcactataaatatgtggcagattcagagctatcatcagaagaaaagaagcagcttgtctatgatattccgacatacgtggagaatgatgatgaaacttattatcttgtttataagttaaattctcaaaatcaactggcggaattgccaaatactggaagcaagaatgagaggcaa

SEQ ID NO: 92 - protein, 66 aa
DAQETAGVHYKYVADSELSSEEKKQLVYDIPTYVENDDETYYLVYKLNSQNQLAELPNTGSKNERQ

SEQ ID NO: 93 - DNA, 835 bp; double-stranded, linear
cgacaaaggtgagactgaggttcaaccagagtcgccagatactgtggtaagtgataaaggtgaaccagagcaggtagcaccgcttccagaatataagggtaatattgagcaagtaaaacctgaaactccggttgagaagaccaaagaacaaggtccagaaaaaactgaagaagttccagtaaaaccaacagaagaaacaccagtaaatccaaatgaaggtactacagaaggaacctcaattcaagaagcagaaaatccagttcaacctgcagaagaatcaacaacgaattcagagaaagtatcaccagatacatctagcaaaaatactggggaagtgtccagtaatcctagtgattcgacaacctcagttggagaatcaaataaaccagaacataatgactctaaaaatgaaaattcagaaaaaactgtagaagaagttccagtaaatccaaatgaaggcacagtagaaggtacctcaaatcaagaaacagaaaaaccagttcaacctgcagaagaaacacaaacaaactctgggaaaatagctaacgaaaatactggagaagtatccaataaacctagtgattcaaaaccaccagttgaagaatcaaatcaaccagaaaaaaacggaactgcaacaaaaccagaaaattcaggtaatacaacatcagagaatggacaaacagaaccagaaccatcaaacggaaattcaactgaggatgtttcaaccgaatcaaacacatccaattcaaatggaaacgaagaaattaaacaagaaaatgaactagaccctgataaaaaggtagaagaaccagagaaaacacttgaattaagaaat

SEQ ID NO: 94 - protein, 278 aa
DKGETEVQPESPDTVVSDKGEPEQVAPLPEYKGNIEQVKPETPVEKTKEQGPEKTEEVPVKPTEETPVNPNEGTTEGTSIQEAENPVQPAEESTTNSEKVSPDTSSKNTGEVSSNPSDSTTSVGESNKPEHNDSKNENSEKTVEEVPVNPNEGTVEGTSNQETEKPVQPAEETQTNSGKIANENTGEVSNKPSDSKPPVEESNQPEKNGTATKPENSGNTTSENGQTEPEPSNGNSTEDVSTESNTSNSNGNEEIKQENELDPDKKVEEPEKTLELRN

SEQ ID NO: 95 - DNA, 709 bp; double-stranded, linear
aaatcaattggtagcacaagatccaaaagcacaagatagcactaaactgactgctgaaaaatcaactgttaaagcacctgctcaaagagtagatgtaaaagatataactcatttaacagatgaagaaaaagttaaggttgctattttacaagcaaatggttcagcattagacggagcgacaatcaatgtagctggagatggtacagcaacaatcacattcccagatggttcagtagtgacgattctaggaaaagatacagttcaacaatctgcgaaaggtgaatctgtaactcaagaagctacaccagagtataagctagaaaatacaccaggtggagataagggaggcaatactggaagctcagatgctaatgcgaatgaaggcggtggtagccaggcgggtggatcagctcacacaggttcacaaaactcagctcaatcacaagcttctaagcaattagctactgaaaaagaatcagctaaaaatgccattgaaaaagcagccaaggacaagcaggatgaaatcaaaggcgcaccgctttctgataaagaaaaagcagaacttttagcaagagtggaagcagaaaaacaagcagctctcaaagagattgaaaatgcgaaaactatggaagatgtgaaggaagcagaaacgattggagtgcaagccattgccatggttacagttcctaagagaccagtggctcctaat

SEQ ID NO: 96 - protein, 236 aa
NQLVAQDPKAQDSTKLTAEKSTVKAPAQRVDVKDITHLTDEEKVKVAILQANGSALDGATINVAGDGTATITFPDGSVVTILGKDTVQQSAKGESVTQEATPEYKLENTPGGDKGGNTGSSDANANEGGGSQAGGSAHTGSQNSAQSQASKQLATEKESAKNAIEKAAKDKQDEIKGAPLSDKEKAELLARVEAEKQAALKEIENAKTMEDVKEAETIGVQAIAMVTVPKRPVAPN

SEQ ID NO: 97 - DNA, 787 bp; double-stranded, linear
caaacagtcagcttcaggaacgattgaggtgatttcacgagaaaatggctctgggacacggggtgccttcacagaaatcacagggattctcaaaaaagacggtgataaaaaaattgacaacactgccaaaacagctgtgattcaaaatagtacagaaggtgttctctcagcagttcaagggaatgctaatgctatcggctacatctccttgggatctttaacgaaatctgtcaaggctttagagattgatggtgtcaaggctagtcgagacacagttttagatggtgaataccctcttcaacgtcccttcaacattgtttggtcttctaatctttccaagctaggtcaagattttatcagctttatccactccaaacaaggtcaacaagtggtcacagataataaatttattgaagctaaaaccgaaaccacggaatatacaagccaacacttatcaggcaagttgtctgttgtaggttccacttcagtatcttctttaatggaaaaattagcagaagcttataaaaaagaaaatccagaagttacgattgatattacctctaatgggtcttcagcaggtattaccgctgttaaggagaaaaccgctgatattggtatggtttctagggaattaactcctgaagaaggtaagagtctcacccatgatgctattgctttagacggtattgctgttgtggtcaataatgacaataaggcaagccaagtcagtatggctgaacttgcagacgtttttagtggcaaattaaccacctgggacaagattaaa

SEQ ID NO: 98 - protein, 262 aa
KQSASGTIEVISRENGSGTRGAFTEITGILKKDGDKKIDNTAKTAVIQNSTEGVLSAVQGNANAIGYISLGSLTKSVKALEIDGVKASRDTVLDGEYPLQRPFNIVWSSNLSKLGQDFISFIHSKQGQQVVTDNKFIEAKTETTEYTSQHLSGKLSVVGSTSVSSLMEKLAEAYKKENPEVTIDITSNGSSAGITAVKEKTADIGMVSRELTPEEGKSLTHDAIALDGIAVVVNNDNKASQVSMAELADVFSGKLTTWDKIK

SEQ ID NO: 99 - DNA, 421 bp; double-stranded, linear
attcgatgatgcggatgaaaagatgacccgtgatgaaattgcctatatgctgacaaatagtgaagaaacattggatgctgatgagattgagatgctacaaggtgtcttttcgctcgatgaactgatggcacgagaggttatggttcctcgaacggatgcctttatggtggatattcaggatgatagtcaagccattatccaaagtattttaaaacaaaattattctcgtatcccggtttatgatggggataaggacaatgtaattggaatcattcacaccaagagtctccttaaggcaggctttgtggacggttttgacaatattgtttggaagagaattttacaagatccactttttgtacctgaaactatttttgtggatgacttgctaaaagaactgcgaaatacccaaagacaaatg

SEQ ID NO: 100 - protein, 140 aa
FDDADEKMTRDEIAYMLTNSEETLDADEIEMLQGVFSLDELMAREVMVPRTDAFMVDIQDDSQAIIQSILKQNYSRIPVYDGDKDNVIGIIHTKSLLKAGFVDGFDNIVWKRILQDPLFVPETIFVDDLLKELRNTQRQM

SEQ ID NO: 101 - DNA, 331 bp; double-stranded, linear
ggagagtcgatcaaaagtagatgaagctgtgtctaagtttgaaaaggactcatcttcttcgtcaagttcagactcttccactaaaccggaagcttcagatacagcgaagccaaacaagccgacagaaccaggagaaaaggtagcagaagctaagaagaaggttgaagaagctgagaaaaaagccaaggatcaaaaagaagaagatcgtcgtaactacccaaccattacttacaaaacgcttgaacttgaaattgctgagtccgatgtggaagttaaaaaagcggagcttgaactagtaaaagtgaaagctaacgaacctcgagacgagcaa

SEQ ID NO: 102 - protein, 110 aa
ESRSKVDEAVSKFEKDSSSSSSSDSSTKPEASDTAKPNKPTEPGEKVAEAKKKVEEAEKKAKDQKEEDRRNYPTITYKTLELEIAESDVEVKKAELELVKVKANEPRDEQ

SEQ ID NO: 103 - DNA, 358 bp; double-stranded, linear
atggacaacaggaaactgggacgaggttatatctggtaagattgacaagtacaaagatccagatattccaacagttgaatcacaagaagttacgtcagactctagtgataaagaaataacggtaaggtatgaccgtttatcaacaccagaaaaaccaatcccacaaccaaatccagagcatccaagtgttccgacaccaaacccagaactaccaaatcaagagactccaacaccagataaaccaactccagaaccaggtactccaaaaactgaaactccagtgaatccagacccagaagttccgacttatgagacaggtaagagagaggaattgccaaacacaggtacagaagctaat

SEQ ID NO: 104 - protein, 119 aa
WTTGNWDEVISGKIDKYKDPDIPTVESQEVTSDSSDKEITVRYDRLSTPEKPIPQPNPEHPSVPTPNPELPNQETPTPDKPTPEPGTPKTETPVNPDPEVPTYETGKREELPNTGTEAN

SEQ ID NO: 105 - DNA, 1879 bp; double-stranded, linear
cgatgggctcaatccaaccccaggtcaagtcttacctgaagagacatcgggaacgaaagagggtgacttatcagaaaaaccaggagacaccgttctcactcaagcgaaacctgagggcgttactggaaatacgaattcacttccgacacctacagaaagaactgaagtgagcgaggaaacaagcccttctagtctggatacactttttgaaaaagatgaagaagctcaaaaaaatccagagctaacagatgtcttaaaagaaactgtagatacagctgatgtggatgggacacaagcaagtccagcagaaactactcctgaacaagtaaaaggtggagtgaaagaaaatacaaaagacagcatcgatgttcctgctgcttatcttgaaaaagctgaagggaaaggtcctttcactgccggtgtaaaccaagtaattccttatgaactattcgctggtgatggtatgttaactcgtctattactaaaagcttcggataatgctccttggtctgacaatggtactgctaaaaatcctgctttacctcctcttgaaggattaacaaaagggaaatacttctatgaagtagacttaaatggcaatactgttggtaaacaaggtcaagctttaattgatcaacttcgcgctaatggtactcaaacttataaagctactgttaaagtttacggaaataaagacggtaaagctgacttgactaatctagttgctactaaaaatgtagacatcaacatcaatggattagttgctaaagaaacagttcaaaaagccgttgcagacaacgttaaagacagtatcgatgttccagcagcctacctagaaaaagccaagggtgaaggtccattcacagcaggtgtcaaccatgtgattccatacgaactcttcgcaggtgatggcatgttgactcgtctcttgctcaaggcatctgacaaggcaccatggtcagataacggcgacgctaaaaacccagccctatctccactaggcgaaaacgtgaagaccaaaggtcaatacttctatcaantagccttggacggaaatgtagctggcaaagaaaaacaagcgctcattgaccagttccgagcaaanggtactcaaacttacagcgctacagtcaatgtctatggtaacaaagacggtaaaccagacttggacaacatcgtagcaactaaaaaagtcactattaacataaacggtttaatttctaaagaaacagttcaaaaagccgttgcagacaacgttaangacagtatcgatgttccagcagcctacctagaaaaagccaagggtgaaggtccattcacagcaggtgtcaaccatgtgattccatacgaactcttcgcaggtgatggtatgttgactcgtctcttgctcaaggcatctgacaaggcaccatggtcagataacggngacgctaaaaacccagcnctatctccactaggtgaaaacgtgaagaccaaaggtcaatacttctatcaantagccttggacggaaatgtagctggcaaagaaaaacaagcgctcattgaccagttccgagcaaacggtactcaaacttacagcgctacagtcaatgtctatggtaacaaagacggtaaaccagacttggacaacatcgtagcaactaaaaaagtcactattaagataaatgttaaagaaacatcagacacagcaaatggttcattatcaccttctaactctggttctggcgtgactccgatgaatcacaatcatgctacaggtactacagatagcatgcctgctgacaccatgacaagttctaccaacacgatggcaggtgaaaacatggctgcttctgctaacaagatgtctgatacgatgatgtcagaggataaagctatg

SEQ ID NO: 106 - protein, 626 aa
DGLNPTPGQVLPEETSGTKEGDLSEKPGDTVLTQAKPEGVTGNTNSLPTPTERTEVSEETSPSSLDTLFEKDEEAQKNPELTDVLKETVDTADVDGTQASPAETTPEQVKGGVKENTKDSIDVPAAYLEKAEGKGPFTAGVNQVIPYELFAGDGMLTRLLLKASDNAPWSDNGTAKNPALPPLEGLTKGKYFYEVDLNGNTVGKQGQALIDQLRANGTQTYKATVKVYGNKDGKADLTNLVATKNVDININGLVAKETVQKAVADNVKDSIDVPAAYLEKAKGEGPFTAGVNHVIPYELFAGDGMLTRLLLKASDKAPWSDNGDAKNPALSPLGENVKTKGQYFYQXALDGNVAGKEKQALIDQFRAXGTQTYSATVNVYGNKDGKPDLDNIVATKKVTININGLISKETVQKAVADNVXDSIDVPAAYLEKAKGEGPFTAGVNHVIPYELFAGDGMLTRLLLKASDKAPWSDNGDAKNPALSPLGENVKTKGQYFYQXALDGNVAGKEKQALIDQFRANGTQTYSATVNVYGNKDGKPDLDNIVATKKVTIKINVKETSDTANGSLSPSNSGSGVTPMNHNHATGTTDSMPADTMTSSTNTMAGENMAASANKMSDTMMSEDKAM

SEQ ID NO: 107 - DNA, 593 bp; double-stranded, linear
ttccaatcaaaaacaggcagatggtaaactcaatatcgtgacaaccttttaccctgtctatgartttaccaagcaagtcgcaggagatacggctaatgtagaactcctaatcggtgctgggacagaacctcatgaatacgaaccatctgccaaggcagttgccaaaatccaagatgcagataccttcgtttatgaaaatgaaaacatggaaacatgggtacctaaattgctagataccttggataagaaaaaagtgaaaaccatcaaggcgacaggcgatatgttgctcttgccaggtggcgaggaagaagagggagaccatgaccatggagaagaaggtcatcaccatgagtttgacccccatgtttggttatcaccagttcgtgccattaaactagtagagcaccatccgcgacacttgtcagcagattatcctgataaaaaagagacctttgagaagaatgcagctgcctatatcgaaaaattgcaagccttggataaggcttacgcagaaggtttgtctcaagcaaaacaaaagagctttgtgactcaacacgcagcctttaactatcttgccttggactatgggactc

SEQ ID NO: 108 - protein, 197 aa
SNQKQADGKLNIVTTFYPVYEFTKQVAGDTANVELLIGAGTEPHEYEPSAKAVAKIQDADTFVYENENMETWVPKLLDTLDKKKVKTIKATGDMLLLPGGEEEEGDHDHGEEGHHHEFDPHVWLSPVRAIKLVEHHPRHLSADYPDKKETFEKNAAAYIEKLQALDKAYAEGLSQAKQKSFVTQHAAFNYLALDYGT

SEQ ID NO: 109 - DNA, 1003 bp; double-stranded, linear
tatcacaggatcgaacggtaagacaaccacaacgactatgattggggaagttttgactgctgctggccaacatggtcttttatcagggaatatcggctatccagctagtcaggttgctcaaatagcatcagataaggacacgcttgttatggaactttcttctttccaactcatgggtgttcaagaattccatccagagattgcggttattaccaacctcatgccaactcatatcgactaccatgggtcattttcggaatatgtagcagccaagtggaatatccagaacaagatgacagcagctgatttccttgtcttgaactttaatcaagacttggcaaaagacttgacttccaagacagaagccactgttgtaccattttcaacacttgaaaaggttgatggagcttatctggaagatggtcaactctacttccgtggtgaagtagtcatggcagcgaatgaaatcggtgttccaggtagccacaatgtggaaaatgcccttgcgactattgctgtagccaagcttcgtgatgtggacaatcaaaccatcaaggaaactctttcagccttcggtggtgtcaaacaccgtctccagtttgtggatgacatcaagggtgttaaattctataacgacagtaaatcaactaatatcttggctactcaaaaagccttgtcaggatttgacaacagcaaggtcgtcttgattgcaggtggtttggaccgtggcaatgagtttgacgaattggtgccagacattactggactcaagaagatggtcatcctgggtcaatctgcagaacgtgtcaaacgggcagcagacaaggctggtgtcgcttatgtggaggcgacagatattgcagatgcgacccgcaaggcctatgagcttgcgactcaaggagatgtggttcttcttagtcctgccaatgctagctgggatatgtatgctaactttgaagtacgtggcgacctctttatcgacacagtagcggagttaaaagaa

SEQ ID NO: 110 - protein, 335 aa
GITGSNGKTTTTTMIGEVLTAAGQHGLLSGNIGYPASQVAQIASDKDTLVMELSSFQLMGVQEFHPEIAVITNLMPTHIDYHGSFSEYVAAKWNIQNKMTAADFLVLNFNQDLAKDLTSKTEATVVPFSTLEKVDGAYLEDGQLYFRGEVVMAANEIGVPGSHNVENALATIAVAKLRDVDNQTIKETLSAFGGVKHRLQFVDDIKGVKFYNDSKSTNILATQKALSGFDNSKVVLIAGGLDRGNEFDELVPDITGLKKMVILGQSAERVKRAADKAGVAYVEATDIADATRKAYELATQGDVVLLSPANASWDMYANFEVRGDLFIDTVAELKE

SEQ ID NO: 111 - DNA, 412 bp; double-stranded, linear
aagttcatcgaagatggttgggaagtccactatatcggggacaagtgtggtatcgaacaccaagaaatccttaagtcaggtttggatgtcaccttccattctattgcgactggaaaattgcgtcgctatttctcttggcaaaatatgctggacgtcttcaaagttggttggggaattgtccaatcgctctttatcatgttgcgactgcgtccacagacccttttttcaaaggggggctttgtctcagtaccgcctgttatcgctgcgcgtgtgtcaggagtgcctgtctttattcacgaatctgacctgtctatgggcttggccaataaaatcgcctataaatttgcgactaagatgtattcaacctttgaacaagcttcgagtttggctaaggttgagcatgtgggagcgg

SEQ ID NO: 112 - protein, 137 aa
SSSKMVGKSTISGTSVVSNTKKSLSQVWMSPSILLRLENCVAISLGKICWTSSKLVGELSNRSLSCCDCVHRPFFQRGALSQYRLLSLRVCQECLSLFTNLTCLWAWPIKSPINLRLRCIQPLNKLRVWLRLSMWER

SEQ ID NO: 113 - DNA, 544 bp; double-stranded, linear
atcgctagctagtgaaatgcaagaaagtacacgtaaattcaaggttactgctgacctaacagatgccggtgttggaacgattgaagttcctttgagcattgaagatttacccaatgggctgaccgctgtggcgactccgcaaaaaattacagtcaagattggtaagaaggctcagaaggataaggtaaagattgtaccagagattgaccctagtcaaattgatagtcgggtacaaattgaaaatgtcatggtgtcagataaagaagtgtctattacgagtgaccaagagacattggatagaattgataagattatcgctgttttgccaactagcgaacgtataacaggtaattacagtggttcagtacctttgcaggcaatcgaccgcaatggtgttgtcttaccggcagttatcactccgtttgatacaataatgaaggtgactacaaaaccagtagcaccaagttcaagcacatcaaattcaagtacaagcagttcatcggagacatcttcgtcaacgaaagcaactagttcaaaaacgaat

SEQ ID NO: 114 - protein, 181 aa
SLASEMQESTRKFKVTADLTDAGVGTIEVPLSIEDLPNGLTAVATPQKITVKIGKKAQKDKVKIVPEIDPSQIDSRVQIENVMVSDKEVSITSDQETLDRIDKIIAVLPTSERITGNYSGSVPLQAIDRNGVVLPAVITPFDTIMKVTTKPVAPSSSTSNSSTSSSSETSSSTKATSSKTN

SEQ ID NO: 115 - DNA, 1267 bp; double-stranded, linear
gcaccagatggggcacaaggttcagggatcagatgttgaaaagtactactttacccaacgcggtcttgagcaggcaggaattaccattcttccttttgatgaaaaaaatctagacggtgatatggaaattatcgctggaaatgcctttcgtccagataacaacgtcgaaattgcctatgcggaccaaaatggtatcagctacaaacgttaccatgagtttctaggtagctttatgcgtgactttgttagcatgggagtagcaggagcacatggaaaaacttcaacgacaggtatgttgtctcatgtcttgtctcacattacagataccagcttcttgattggagatgggacaggtcgtggttcggccaatgccaaatattttgtctttgaatctgacgaatatgagcgtcacttcatgccttaccacccagaatactctattatcaccaacattgactttgaccatccagattatttcacaagtctcgaggatgtttttaatgcctttaacgactatgccaaacaaatcaccaagggtctttttgtctatggtgaagatgctgaattgcgtaagattacgtctgatgcaccaatttattattatggttttgaagctgaaggcaatgactttgtagctagtgatcttcttcgttcaataactggttcaaccttcaccgttcatttccgtggacaaaacttggggcaattccacattccaacctttggtcgtcacaatatcatgaatgcgacagccgttattggtcttctttacacagcaggatttgatttgaacttggtgcgtgagcacttgaaaacatttgccggtgttaaacgtcgtttcactgagaaaattgtcaatgatacagtgattatcgatgactttgcccaccatccaacagaaattattgcgaccttggatgcggctcgtcagaaatacccaagcaaggaaattgtagcagtctttcaaccgcatacctttacaagaaccattgccttgttggacgactttgcccatgctttaaaccaagcagatgctgtttatctagcgcaaatttatggctcggctcgtgaagtagatcatggtgacgttaaggtagaagacctagccaacaaaatcaacaaaaaacaccaagtgattactgttgaaaatgtttctccactcctagaccatgacaatgctgtttacgtctttatgggagcaggagacatccaaacctatgaatactcatttgagcgtctcttgtctaacttgacaagcaatgttcaa

SEQ ID NO: 116 - protein, 422 aa
HQMGHKVQGSDVEKYYFTQRGLEQAGITILPFDEKNLDGDMEIIAGNAFRPDNNVEIAYADQNGISYKRYHEFLGSFMRDFVSMGVAGAHGKTSTTGMLSHVLSHITDTSFLIGDGTGRGSANAKYFVFESDEYERHFMPYHPEYSIITNIDFDHPDYFTSLEDVFNAFNDYAKQITKGLFVYGEDAELRKITSDAPIYYYGFEAEGNDFVASDLLRSITGSTFTVHFRGQNLGQFHIPTFGRHNIMNATAVIGLLYTAGFDLNLVREHLKTFAGVKRRFTEKIVNDTVIIDDFAHHPTEIIATLDAARQKYPSKEIVAVFQPHTFTRTIALLDDFAHALNQADAVYLAQIYGSAREVDHGDVKVEDLANKINKKHQVITVENVSPLLDHDNAVYVFMGAGDIQTYEYSFERLLSNLTSNVQ

SEQ ID NO: 117 - DNA, 3121 bp; double-stranded, linear
ttttaacccaactgttggtactttcctttttactgcaggattgagcttgttagttttattggtttctaaaagggaaaatggaaagaaacgacttgttcattttctgctgttgactagcatgggagttcaattgttgccggccagtgcttttgggttgaccagccagattttatctgcctataatagtcagctttctatcggagtcggggaacatttaccagagcctctgaaaatcgaaggttatcaatatattggttatatcaaaactaagaaacaggataatacagagctttcaaggacagttgatgggaaatactctgctcaaagagatagtcaaccaaactctacaaaaacatcagatgtagttcattcagctgatttagaatggaaccaaggacaggggaaggttagtttacaaggtgaagcatcaggggatgatggactttcagaaaaatcttctatagcagcagacaatctatcttctaatgattcattcgcaagtcaagttgagcagaatccggatcacaaaggagaatctgtagttcgaccaacagtgccagaacaaggaaatcctgtgtctgctacaacggtgcagagtgcggaagaggaagtattggcgacgacaaatgatcgaccagagtataaacttccattggaaaccaaaggcacgcaagaacccggtcatgagggtgaagccgcagtccgtgaagacttaccagtctacactaagccactagaaaccaaaggtacacaaggacccggacatgaaggtgaagctgcagttcgcgaggaagaaccagcttacacagaaccgttagcaacgaaaggcacgcaagagccaggtcatgagggcaaagctacagtccgcgaagagactctagagtacacggaaccggtagcgacaaaaggcacacaagaacccgaacatgagggcgaacggscagtagaagaagaacttccggctttagaggtcactacacgaaatagaacggaaatccagaatattccttatacaacagaagaaattcaggatccaacacttctgaaaaatcgtcgtaagattgaacgacaagggcaagcagggacacgtacaattcaatatgaagactacatcgtaaatggtaatgtcgtagaaactaaagaagtgtcacgaactgaagtagctccggtcaacgaagtcgttaaagtaggaacacttgtgaaagttaaacctacagtagaaattacaaacttaacaaaagttgagaacaaaaaatctataactgtaagttataacttaatagacactacctcagcatatgtttctgcaaaaacgcaagttttccatggagacaagctagttaaagaggtggatatagaaaatcctgccaaagagcaagtaatatcaggtttagattactacacaccgtatacagttaaaacacacctaacttataatttgggtgaaaataatgaggaaaatactgaaacatcaactcaagatttccaattagagtataagaaaatagagattaaagatattgattcagtagaattatacggtaaagaaaatgatcgttatcgtagatatttaagtctaagtgaagcgccgactgatacggctaaatactttgtaaaagtgaaatcagatcgcttcaaagaaatgtacctacctgtaaaatctattacagaaaatacggatggaacgtataaagtgacggtagccgttgatcaacttgtcgaagaaggtacagacggttacaaagatgattacacatttactgtagctaaatctaaagcagagcaaccaggagtttacacatcctttaaacagctggtaacagccatgcaaagcaatctgtctggtgtctatacattggcttcagatatgaccgcagatgaggtgagcttaggcgataagcagacaagttatctcacaggtgcatttacagggagcttgatcggttctgatggaacaaaatcgtatgccatttatgatttgaagaaaccattatttgatacattaaatggtgctacagttagagatttggatattaaaactgtttctgctgatagtaaagaaaatgtcgcagcgctggcgaaggcagcgaatagcgcgaatattaataatgttgcagtagaaggaaaaatctcaggtgcgaaatctgttgcgggattagtagcgagcgcaacaaatacagtgatagaaaacagctcgtttacagggaaacttatcgcaaatcaccaggacagtaataaaaatgatactggaggaatagtaggtaatataacaggaaatagttcgagagttaataaagttagggtagatgccttaatctctactaatgcacgcaataataaccaaacagctggagggatagtaggtagattagaaaatggtgcattgatatctaattcggttgctactggagaaatacgaaatggtcaaggatattctagagtcggaggaatagtaggatctacgtggcaaaacggtcgagtaaataatgttgtgagtaacgtagatgttggagatggttatgttatcaccggtgatcaatacgcagcagcagatgtgaaaaatgcaagtacatcagttgataatagaaaagcagacagattcgctacaaaattatcaaaagaccaaatagacgcgaaagttgctgattatggaatcacagtaactcttgatgatactgggcaagatttaaaacgtaatctaagagaagttgattatacaagactaaataaagcagaagctgaaagaaaagtagcttatagcaacatagaaaaactgatgccattctacaataaagacctagtagttcactatggtaacaaagtagcgacaacagataaactttacactacagaattgttagatgttgtgccgatgaaagatgatgaagtagtaacggatattaataataagaaaaattcaataaataaagttatgttacatttcaaagataatacagtagaatacctagatgtaacattcaaagaaaacttcataaacagtcaagtaatcgaatacaatgttacaggaaaagaatatatattcacaccagaagcatttgtttcagactatacagcgataacgaataacgtactaagcgacttgcaaaatgtaacacttaac

SEQ ID NO: 118 - protein, 1040 aa
FNPTVGTFLFTAGLSLLVLLVSKRENGKKRLVHFLLLTSMGVQLLPASAFGLTSQILSAYNSQLSIGVGEHLPEPLKIEGYQYIGYIKTKKQDNTELSRTVDGKYSAQRDSQPNSTKTSDVVHSADLEWNQGQGKVSLQGEASGDDGLSEKSSIAADNLSSNDSFASQVEQNPDHKGESVVRPTVPEQGNPVSATTVQSAEEEVLATTNDRPEYKLPLETKGTQEPGHEGEAAVREDLPVYTKPLETKGTQGPGHEGEAAVREEEPAYTEPLATKGTQEPGHEGKATVREETLEYTEPVATKGTQEPEHEGERXVEEELPALEVTTRNRTEIQNIPYTTEEIQDPTLLKNRRKIERQGQAGTRTIQYEDYIVNGNVVETKEVSRTEVAPVNEVVKVGTLVKVKPTVEITNLTKVENKKSITVSYNLIDTTSAYVSAKTQVFHGDKLVKEVDIENPAKEQVISGLDYYTPYTVKTHLTYNLGENNEENTETSTQDFQLEYKKIEIKDIDSVELYGKENDRYRRYLSLSEAPTDTAKYFVKVKSDRFKEMYLPVKSITENTDGTYKVTVAVDQLVEEGTDGYKDDYTFTVAKSKAEQPGVYTSFKQLVTAMQSNLSGVYTLASDMTADEVSLGDKQTSYLTGAFTGSLIGSDGTKSYAIYDLKKPLFDTLNGATVRDLDIKTVSADSKENVAALAKAANSANINNVAVEGKISGAKSVAGLVASATNTVIENSSFTGKLIANHQDSNKNDTGGIVGNITGNSSRVNKVRVDALISTNARNNNQTAGGIVGRLENGALISNSVATGEIRNGQGYSRVGGIVGSTWQNGRVNNVVSNVDVGDGYVITGDQYAAADVKNASTSVDNRKADRFATKLSKDQIDAKVADYGITVTLDDTGQDLKRNLREVDYTRLNKAEAERKVAYSNIEKLMPFYNKDLVVHYGNKVATTDKLYTTELLDVVPMKDDEVVTDINNKKNSINKVMLHFKDNTVEYLDVTFKENFINSQVIEYNVTGKEYIFTPEAFVSDYTAITNNVLSDLQNVTLN

SEQ ID NO: 119 - DNA, 1567 bp; double-stranded, linear
ttttaacccaactgttggtactttcctttttactgcaggattgagcttgttagttttattggtttctaaaagggaaaatggaaagaaacgacttgttcattttctgctgttgactagcatgggagttcaattgttgccggccagtgcttttgggttgaccagccagattttatctgcctataatagtcagctttctatcggagtcggggaacatttaccagagcctctgaaaatcgaaggttatcaatatattggttatatcaaaactaagaaacaggataatacagagctttcaaggacagttgatgggaaatactctgctcaaagagatagtcaaccaaactctacaaaaacatcagatgtagttcattcagctgatttagaatggaaccaaggacaggggaaggttagtttacaaggtgaagcatcaggggatgatggactttcagaaaaatcttctatagcagcagacaatctatcttctaatgattcattcgcaagtcaagttgagcagaatccggatcacaaaggagaatctgtagttcgaccaacagtgccagaacaaggaaatcctgtgtctgctacaacggtgcagagtgcggaagaggaagtattggcgacgacaaatgatcgaccagagtataaacttccattggaaaccaaaggcacgcaagaacccggtcatgagggtgaagccgcagtccgtgaagacttaccagtctacactaagccactagaaaccaaaggtacacaaggacccggacatgaaggtgaagctgcagttcgcgaggaagaaccagcttacacagaaccgttagcaacgaaaggcacgcaagagccaggtcatgagggcaaagctacagtccgcgaagagactctagagtacacggaaccggtagcgacaaaaggcacacaagaacccgaacatgagggcgaacggscagtagaagaagaacttccggctttagaggtcactacacgaaatagaacggaaatccagaatattccttatacaacagaagaaattcaggatccaacacttctgaaaaatcgtcgtaagattgaacgacaagggcaagcagggacacgtacaattcaatatgaagactacatcgtaaatggtaatgtcgtagaaactaaagaagtgtcacgaactgaagtagctccggtcaacgaagtcgttaaagtaggaacacttgtgaaagttaaacctacagtagaaattacaaacttaacaaaagttgagaacaaaaaatctataactgtaagttataacttaatagacactacctcagcatatgtttctgcaaaaacgcaagttttccatggagacaagctagttaaagaggtggatatagaaaatcctgccaaagagcaagtaatatcaggtttagattactacacaccgtatacagttaaaacacacctaacttataatttgggtgaaaataatgaggaaaatactgaaacatcaactcaagatttccaattagagtataagaaaatagagattaaagatattgattcagtagaattatacggtaaagaaaatgatcgttatcgtaga

SEQ ID NO: 120 - protein, 522 aa
FNPTVGTFLFTAGLSLLVLLVSKRENGKKRLVHFLLLTSMGVQLLPASAFGLTSQILSAYNSQLSIGVGEHLPEPLKIEGYQYIGYIKTKKQDNTELSRTVDGKYSAQRDSQPNSTKTSDVVHSADLEWNQGQGKVSLQGEASGDDGLSEKSSIAADNLSSNDSFASQVEQNPDHKGESVVRPTVPEQGNPVSATTVQSAEEEVLATTNDRPEYKLPLETKGTQEPGHEGEAAVREDLPVYTKPLETKGTQGPGHEGEAAVREEEPAYTEPLATKGTQEPGHEGKATVREETLEYTEPVATKGTQEPEHEGERXVEEELPALEVTTRNRTEIQNIPYTTEEIQDPTLLKNRRKIERQGQAGTRTIQYEDYIVNGNVVETKEVSRTEVAPVNEVVKVGTLVKVKPTVEITNLTKVENKKSITVSYNLIDTTSAYVSAKTQVFHGDKLVKEVDIENPAKEQVISGLDYYTPYTVKTHLTYNLGENNEENTETSTQDFQLEYKKIEIKDIDSVELYGKENDRYRR

SEQ ID NO: 121 - DNA, 1561 bp; double-stranded, linear
tcgtagatatttaagtctaagtgaagcgccgactgatacggctaaatactttgtaaaagtgaaatcagatcgcttcaaagaaatgtacctacctgtaaaatctattacagaaaatacggatggaacgtataaagtgacggtagccgttgatcaacttgtcgaagaaggtacagacggttacaaagatgattacacatttactgtagctaaatctaaagcagagcaaccaggagtttacacatcctttaaacagctggtaacagccatgcaaagcaatctgtctggtgtctatacattggcttcagatatgaccgcagatgaggtgagcttaggcgataagcagacaagttatctcacaggtgcatttacagggagcttgatcggttctgatggaacaaaatcgtatgccatttatgatttgaagaaaccattatttgatacattaaatggtgctacagttagagatttggatattaaaactgtttctgctgatagtaaagaaaatgtcgcagcgctggcgaaggcagcgaatagcgcgaatattaataatgttgcagtagaaggaaaaatctcaggtgcgaaatctgttgcgggattagtagcgagcgcaacaaatacagtgatagaaaacagctcgtttacagggaaacttatcgcaaatcaccaggacagtaataaaaatgatactggaggaatagtaggtaatataacaggaaatagttcgagagttaataaagttagggtagatgccttaatctctactaatgcacgcaataataaccaaacagctggagggatagtaggtagattagaaaatggtgcattgatatctaattcggttgctactggagaaatacgaaatggtcaaggatattctagagtcggaggaatagtaggatctacgtggcaaaacggtcgagtaaataatgttgtgagtaacgtagatgttggagatggttatgttatcaccggtgatcaatacgcagcagcagatgtgaaaaatgcaagtacatcagttgataatagaaaagcagacagattcgctacaaaattatcaaaagaccaaatagacgcgaaagttgctgattatggaatcacagtaactcttgatgatactgggcaagatttaaaacgtaatctaagagaagttgattatacaagactaaataaagcagaagctgaaagaaaagtagcttatagcaacatagaaaaactgatgccattctacaataaagacctagtagttcactatggtaacaaagtagcgacaacagataaactttacactacagaattgttagatgttgtgccgatgaaagatgatgaagtagtaacggatattaataataagaaaaattcaataaataaagttatgttacatttcaaagataatacagtagaatacctagatgtaacattcaaagaaaacttcataaacagtcaagtaatcgaatacaatgttacaggaaaagaatatatattcacaccagaagcatttgtttcagactatacagcgataacgaataacgtactaagcgacttgcaaaatgtaacacttaac

SEQ ID NO: 122 - protein, 520 aa
RRYLSLSEAPTDTAKYFVKVKSDRFKEMYLPVKSITENTDGTYKVTVAVDQLVEEGTDGYKDDYTFTVAKSKAEQPGVYTSFKQLVTAMQSNLSGVYTLASDMTADEVSLGDKQTSYLTGAFTGSLIGSDGTKSYAIYDLKKPLFDTLNGATVRDLDIKTVSADSKENVAALAKAANSANINNVAVEGKISGAKSVAGLVASATNTVIENSSFTGKLIANHQDSNKNDTGGIVGNITGNSSRVNKVRVDALISTNARNNNQTAGGIVGRLENGALISNSVATGEIRNGQGYSRVGGIVGSTWQNGRVNNVVSNVDVGDGYVITGDQYAAADVKNASTSVDNRKADRFATKLSKDQIDAKVADYGITVTLDDTGQDLKRNLREVDYTRLNKAEAERKVAYSNIEKLMPFYNKDLVVHYGNKVATTDKLYTTELLDVVPMKDDEVVTDINNKKNSINKVMLHFKDNTVEYLDVTFKENFINSQVIEYNVTGKEYIFTPEAFVSDYTAITNNVLSDLQNVTLN

SEQ ID NO: 123 - DNA, 850 bp; double-stranded, linear
ctttggttttgaaggaagtaagcgtggacaatttgctgtagaaggaatcaatcaacttcgtgagcatgtagacactctattgattatctcaaacaacaatttgcttgaaattgttgataagaaaacaccgcttttggaggctcttagcgaagcggataacgttcttcgtcaaggtgttcaagggattaccgatttgattaccaatccaggattgattaaccttgactttgccgatgtgaaaacggtaatggcaaacaaagggaatgctcttatgggtattggtatcggtagtggagaagaacgtgtggtagaagcggcacgtaaggcaatctattcaccacttcttgaaacaactattgacggtgctgaggatgttatcgtcaacgttactggtggtcttgacttaaccttgattgaggcagaagaggcttcacaaattgtgaaccaggcagcaggtcaaggagtgaacatctggctcggtacttcaattgatgaaagtatgcgtgatgaaattcgtgtaacagttgttgcaacgggtgttcgtcaagaccgcgtagaaaaggttgtggctccacaagctagatctgctactaactaccgtgagacagtgaaaccagctcattcacatggctttgatcgtcattttgatatggcagaaacagttgaattgccaaaacaaaatccacgtcgtttggaaccaactcaggcatctgcttttggtgattgggatcttcgccgtgaatcgattgttcgtacaacagattcagtcgtttctccagtcgagcgctttgaagccccaatttcacaagatgaagatgaattggatacacctccatttttcaaaaatcgt

SEQ ID NO: 124 - protein, 283 aa
FGFEGSKRGQFAVEGINQLREHVDTLLIISNNNLLEIVDKKTPLLEALSEADNVLRQGVQGITDLITNPGLINLDFADVKTVMANKGNALMGIGIGSGEERVVEAARKAIYSPLLETTIDGAEDVIVNVTGGLDLTLIEAEEASQIVNQAAGQGVNIWLGTSIDESMRDEIRVTVVATGVRQDRVEKVVAPQARSATNYRETVKPAHSHGFDRHFDMAETVELPKQNPRRLEPTQASAFGDWDLRRESIVRTTDSVVSPVERFEAPISQDEDELDTPPFFKNR

SEQ ID NO: 125 - DNA, 1051 bp; double-stranded, linear
ctactacctctcgagagaaagtgacctagaggtgaccgtttttgaccatgagcaaggtcaagccaccaaggccgcagcaggaattatcagtccttggttttccaaacgccgtaataaagcctggtacaagatggcgcgcttgggggctgatttttatgtggatttattagctgatttagagaaatcaggacaagaaatcgacttttaccagcgttcgggagtctttctcttgaaaaaggatgaatccaatttggaagaactttatcaactggccctccagcgcagagaagaatctcccttgatagggcaattagccattctgaaccaagcctcagctaatgaattattccctggtttgcagggatttgaccgcctgctctatgcttctggtggagcgagagtagatggccaacttttagtgactcgtttgctggaagtcagtcatgtcaagctggtcaaagaaaaagtgactctgacaccgttagcatcaggctaccagattggtgaagaggagtttgagcaggttattttggcgacgggagcttggttgggggacatgttagagcctttaggttatgaagtggatgtccgtcctcaaaaaggacaactacgagattatcagcttgcccaagacatggaagattaccctgttgtcatgccagaaggggagtgggatttgattccctttgcaggtgggaaattatccttaggcgctacccacgaaaatgacatgggatttgatttgacggtagatgaaaccttgctccaacaaatggaggaggccaccttgactcactatctgattttggctgaagctacttcaaaatctgagcgtgttggaatccgtgcctacaccagtgatttctctcctttctttgggcaggtgcctgacttaactggtgtctatgcagccagtggactaggttcatcaggcctcacaactggtcctatcattggttaccatctagcccaactgatccaagacaaggagttgaccttggaccctctaaattacccaattgaaaactatgtcaaacgagtaaaaagcgaa

SEQ ID NO: 126 - protein, 350 aa
YYLSRESDLEVTVFDHEQGQATKAAAGIISPWFSKRRNKAWYKMARLGADFYVDLLADLEKSGQEIDFYQRSGVFLLKKDESNLEELYQLALQRREESPLIGQLAILNQASANELFPGLQGFDRLLYASGGARVDGQLLVTRLLEVSHVKLVKEKVTLTPLASGYQIGEEEFEQVILATGAWLGDMLEPLGYEVDVRPQKGQLRDYQLAQDMEDYPVVMPEGEWDLIPFAGGKLSLGATHENDMGFDLTVDETLLQQMEEATLTHYLILAEATSKSERVGIRAYTSDFSPFFGQVPDLTGVYAASGLGSSGLTTGPIIGYHLAQLIQDKELTLDPLNYPIENYVKRVKSE

SEQ ID NO: 127 - DNA, 352 bp; double-stranded, linear
taaggtcaaaagtcagaccgctaagaaagtgctagaaaagattggagctgactcggttatctcgccagagtatgaaatggggcagtctctagcacagaccattcttttccataatagtgttgatgtctttcagttggataaaaatgtgtctatcgtggagatgaaaattcctcagtcttgggcaggtcaaagtctgagtaaattagacctccgtggcaaatacaatctgaatattttgggtttccgagagcaggaaaattccccattggatgttgaatttggaccagatgacctcttgaaagcagatacctatattttggcagtcatcaacaaccagtatttggatacccta

SEQ ID NO: 128 - protein, 117 aa
KVKSQTAKKVLEKIGADSVISPEYEMGQSLAQTILFHNSVDVFQLDKNVSIVEMKIPQSWAGQSLSKLDLRGKYNLNILGFREQENSPLDVEFGPDDLLKADTYILAVINNQYLDTL

SEQ ID NO: 129 - DNA, 247 bp; double-stranded, linear
tgacgggtctcaggatcagactcaggaaatcgctgagtgtttagctagcaagtatcctaatatcgttagagccatctatcaggaaaataaatgccatggcggtgcggtcaatcgtggcttggtagaggcttctgggcgctattttaaagtagttgacagtgatgactgggtggatcctcgtgcctacttgaaaattcttgaaacttgcaggaacttgagagcaaaggtcaagaggtggatgtctttg

SEQ ID NO: 130 - protein, 82 aa
DGSQDQTQEIAECLASKYPNIVRAIYQENKCHGGAVNRGLVEASGRYFKVVDSDDWVDPRAYLKILETCRNLRAKVKRWMSL

SEQ ID NO: 131 - DNA, 1744 bp; double-stranded, linear
tagaggctttgccaaatggtgggaagggcacgagcgtcgaaaagaggaacgctttgtcaaacaagaagaaaaagctcgccaaaaggctgagaaagaggctagattagaacaagaagagactgaaaaagccttactcgatttgcctcctgttgatatggaaacgggtgaaattctgacagaggaagctgttcaaaatcttccacctattccagaagaaaagtgggtggaaccagaaatcatcctgcctcaagctgaacttaaattccctgaacaggaagatgactcagatgacgaagatgttcaggtcgatttttcagccaaagaagcccttgaatacaaacttccaagcttacaactctttgcaccagataaaccaaaagatcagtctaaagagaagaaaattgtcagagaaaatatcaaaatcttagaagcaacctttgctagctttggtattaaggtaacagttgaacgggccgaaattgggccatcagtgaccaagtatgaagtcaagccggctgttggtgtaagggtcaaccgcatttccaatctatcagatgacctcgctctagccttggctgccaaagatgtccggattgaagcaccaatccctgggaaatccctaatcggaattgaagtgcccaactccgatattgccactgtatctttccgagaactatgggaacaatcgcaaacgaaagcagaaaatttcttggaaattcctttagggaaggctgttaatggaaccgcaagagcttttgacctttctaaaatgccccacttgctagttgcaggttcaacgggttcagggaagtcagtagcagttaacggcattattgctagcattctcatgaaggcgagaccagatcaagttaaatttatgatggtcgatcccaagatggttgagttatctgtttacaatgatattccccacctcttgattccagtcgtgaccaatccacgcaaagccagcaaggctctgcaaaaggttgtggatgaaatggaaaaccgttatgaactctttgccaaggtgggagttcggaatattgcaggttttaatgccaaggtagaagagttcaattcccagtctgagtacaagcaaattccgctaccattcattgtcgtgattgtggatgagttggctgacctcatgatggtggccagcaaggaagtggaagatgctatcatccgtcttgggcagaaggcgcgtgctgcaggtatccacatgattcttgcaactcagcgtccatctgttgatgtcatctctggtttgattaaggccaatgttccatctcgtgtagcatttgcggtttcatcaggaacagactcccgtacgattttggatgaaaatggagcagaaaaacttcttggtcgaggagacatgctctttaaaccgattgatgaaaatcatccagttcgtctccaaggctcctttatctcggatgacgatgttgagcgcattgtgaacttcatcaagactcaggcagatgcagactacgatgagagttttgatccaggtgaggtttctgaaaatgaaggagaattttcggatggagatgctggtggtgatccgctttttgaagaagctaagtctttggttatcgaaacacagaaagccagtgcgtctatgattcagcgtcgtttatcagttggatttaaccgtgcgacccgtctcatggaagaactggagatagcaggtgtcatcggtccagctgaaggtaccaaacctcgaaaagtgttacaacaa

SEQ ID NO: 132 - protein, 581 aa
RGFAKWWEGHERRKEERFVKQEEKARQKAEKEARLEQEETEKALLDLPPVDMETGEILTEEAVQNLPPIPEEKWVEPEIILPQAELKFPEQEDDSDDEDVQVDFSAKEALEYKLPSLQLFAPDKPKDQSKEKKIVRENIKILEATFASFGIKVTVERAEIGPSVTKYEVKPAVGVRVNRISNLSDDLALALAAKDVRIEAPIPGKSLIGIEVPNSDIATVSFRELWEQSQTKAENFLEIPLGKAVNGTARAFDLSKMPHLLVAGSTGSGKSVAVNGIIASILMKARPDQVKFMMVDPKMVELSVYNDIPHLLIPVVTNPRKASKALQKVVDEMENRYELFAKVGVRNIAGFNAKVEEFNSQSEYKQIPLPFIVVIVDELADLMMVASKEVEDAIIRLGQKARAAGIHMILATQRPSVDVISGLIKANVPSRVAFAVSSGTDSRTILDENGAEKLLGRGDMLFKPIDENHPVRLQGSFISDDDVERIVNFIKTQADADYDESFDPGEVSENEGEFSDGDAGGDPLFEEAKSLVIETQKASASMIQRRLSVGFNRATRLMEELEIAGVIGPAEGTKPRKVLQQ

SEQ ID NO: 133 - DNA, 829 bp; double-stranded, linear
tcaaaaagagaaggaaaacttggttattgctgggaaaataggtccagaaccagaaattttggccaatatgtataagttgctgattgaagaaaataccagcatgactgcgactgttaaaccgaattttgggaagacaagcttcctttatgaagctctgaaaaaaggcgatattgacatctatcctgaatttactggtacggtgactgaaagtttgcttcaaccatcacccaaggtgagtcatgaaccagaacaggtttatcaggtggcgcgtgatggcattgctaagcaggatcatctagcctatctcaaacccatgtcttatcaaaacacctatgctgtagctgttccgaaaaagattgctcaagaatatggcttgaagaccatttcagacttgaaaaaagtggaagggcagttgaaggcaggttttacactcgagtttaacgaccgtgaagatggaaataagggcttgcaatcaatgtatggtctcaatctcaatgtagcgaccattgagccagcccttcgctatcaggctattcagtcaggggatattcaaatcacggatgcctattcgactgatgcggaattggagcgttatgatttacaggtcttggaagatgacaagcaactcttcccaccttatcaaggggctccactcatgaaagaagctcttctcaagaaacacccagagttggaaagagttcttaatacattggctggtaagattacagaaagccagatgagccagctcaactaccaagtcggtgttgaaggcaagtcagcaaagcaagtagccaaggagtttctccaagaacaaggtttgttgaagaaa

SEQ ID NO: 134 - protein, 276 aa
QKEKENLVIAGKIGPEPEILANMYKLLIEENTSMTATVKPNFGKTSFLYEALKKGDIDIYPEFTGTVTESLLQPSPKVSHEPEQVYQVARDGIAKQDHLAYLKPMSYQNTYAVAVPKKIAQEYGLKTISDLKKVEGQLKAGFTLEFNDREDGNKGLQSMYGLNLNVATIEPALRYQAIQSGDIQITDAYSTDAELERYDLQVLEDDKQLFPPYQGAPLMKEALLKKHPELERVLNTLAGKITESQMSQLNYQVGVEGKSAKQVAKEFLQEQGLLKK

SEQ ID NO: 135 - DNA, 712 bp; double-stranded, linear
acgttctattgaggaccactttgattcaaacttcgaattggaatataacctcaaagaaaaagggaaaacagatcttttgaagctagttgataaaacaactgacatgcgtctgcattttatccgccaaactcatccacgcggtctcggagatgctgttttgcaagccaaggctttcgtcggaaatgaaccttttgtcgttatgcttggtgatgacttgatggatatcacagacgaaaaggctgttccacttaccaaacaactcatggatgactacgagcgtacccacgcgtctactatcgctgtcatgccagtccctcatgacgaagtatctgcttacggggttattgctccgcaaggcgaaggaaaagatggtctttacagtgttgaaacctttgttgaaaaaccagctccagaggacgctcctagcgaccttgctattatcggacgctacctcctcacgcctgaaatttttgagattctcgaaaagcaagctccaggtgcaggaaatgaaattcagctgacagatgcaatcgacaccctcaataaaacacaacgtgtatttgctcgtgagttcaaaggggctcgttacgatgtcggagacaagtttggcttcatgaaaacatccatcgactacgccctcaaacacccacaagtcaaagatgatttgaagaattacctcatccaacttggaaaagaattgactgagaaggaa

SEQ ID NO: 136 - protein, 237 aa
RSIEDHFDSNFELEYNLKEKGKTDLLKLVDKTTDMRLHFIRQTHPRGLGDAVLQAKAFVGNEPFVVMLGDDLMDITDEKAVPLTKQLMDDYERTHASTIAVMPVPHDEVSAYGVIAPQGEGKDGLYSVETFVEKPAPEDAPSDLAIIGRYLLTPEIFEILEKQAPGAGNEIQLTDAIDTLNKTQRVFAREFKGARYDVGDKFGFMKTSIDYALKHPQVKDDLKNYLIQLGKELTEKE

SEQ ID NO: 137 - DNA, 502 bp; double-stranded, linear
cgctcaaaataccagaggtgttcagctaatcgagcacgtttctcctcaaatgttgaaagcccaattggagagtgtcttttctgatattccacctcaggctgtaaaaactggaatgttggctactactgaaatcatggaaatcatccaaccctatcttaaaaaactggattgtccctatgtccttgatcctgttatggttgctacaagtggagatgccttgattgactcaaatgctagagactatctcaaaacaaacttactacctctagcaactattattacgccaaatcttcctgaagcagaagagattgttggtttttcaatccatgaccccgaagacatgcagcgtgctggtcgcctgattttaaaagaatttggtcctcagtctgtggttatcaaaggcggacatctcaaaggtggtgctaaagatttcctctttaccaagaatgaacaatttgtctgggaaagcccacgaattcaaacctgtcacacccatggtact

SEQ ID NO: 138 - protein, 167 aa
AQNTRGVQLIEHVSPQMLKAQLESVFSDIPPQAVKTGMLATTEIMEIIQPYLKKLDCPYVLDPVMVATSGDALIDSNARDYLKTNLLPLATIITPNLPEAEEIVGFSIHDPEDMQRAGRLILKEFGPQSVVIKGGHLKGGAKDFLFTKNEQFVWESPRIQTCHTHGT

SEQ ID NO: 139 - DNA, 805 bp; double-stranded, linear
aattgtacaattagaaaaagatagcaaatcagacaaagaacaagttgataaactatttgaatcatttgatgcatcttcagatgaatctatttctaaattaaaagaactatctgaaacttcacttaaaaccgatgcaggtaaagactatcttaataacaaagtcaaagaatcatctaaagcaattgtagattttcatttgcaaaaaggtttggcttatgatgttaaagattcagatgacaaatttaaagataaagcaactcttgaaacaaatgtaaaagaaattacaaaacaaattgattttatcaaaaaagttgatgaaacttttaaacaagagaatttggaagaaactcttaaatctctaaatgatcttgttgataaatatcaaaaacaaatcgaacttttgaagaaagaagaagaaaaagctgctgaaaaagctgctgaaaaagcaaaggaatcttctagtcaaagtaattcttctggtagtgcttctaatgagtcttataatggatcttccaattcaaatgtagattatagttcatctgaacaaactaatggatattcaaataattatggcggtcaagattattctggttcaggagatagttcaacaaatggtggatcatcagaacaatattcatctagcaattcaaacagcggagcaaataatgtctacagatataaaggcactggtgctgacggctatcaaagatactactacaaagatcataataatggagatgtgtatgatgacgatggaaattaccttgggaactttggtggcggcattgcagaacctagtcaacgc

SEQ ID NO: 140 - protein, 268 aa
IVQLEKDSKSDKEQVDKLFESFDASSDESISKLKELSETSLKTDAGKDYLNNKVKESSKAIVDFHLQKGLAYDVKDSDDKFKDKATLETNVKEITKQIDFIKKVDETFKQENLEETLKSLNDLVDKYQKQIELLKKEEEKAAEKAAEKAKESSSQSNSSGSASNESYNGSSNSNVDYSSSEQTNGYSNNYGGQDYSGSGDSSTNGGSSEQYSSSNSNSGANNVYRYKGTGADGYQRYYYKDHNNGDVYDDDGNYLGNFGGGIAEPSQR

SEQ ID NO: 141 - DNA, 211 bp; double-stranded, linear
tctgaccaagcaaaaagaagcagtcaatgacaaaggaaaagcagctgttgttaaggtggtggaaagccaggcagaactttatagcttagaaaagaatgaagatgctagcctaagaaagttacaagcagatggacgcatcacggaagaacaggctaaagcttataaagaatacaatgataaaaatggaggagcaaatcgtaaagtcaatgat

SEQ ID NO: 142 - protein, 70 aa
LTKQKEAVNDKGKAAVVKVVESQAELYSLEKNEDASLRKLQADGRITEEQAKAYKEYNDKNGGANRKVND

SEQ ID NO: 143 - DNA, 331 bp; double-stranded, linear
gtccggctctgtccagtccactttttcagcggtagaggaacagattttctttatggagtttgaagaactctatcgggaaacccaaaaacgcagtgtagccagtcagcaaaagactagtctgaacttagatgggcagacgcttagcaatggcagtcaaaagttgccagtccctaaaggaattcaggccccatcaggccaaagtattacatttgaccgagctgggggcaattcgtccctggctaaggttgaatttcagaccagtaaaggagcgattcgctatcaattatatctaggaaatggaaaaattaaacgcattaaggaaacaaaaaat

SEQ ID NO: 144 - protein, 110 aa
SGSVQSTFSAVEEQIFFMEFEELYRETQKRSVASQQKTSLNLDGQTLSNGSQKLPVPKGIQAPSGQSITFDRAGGNSSLAKVEFQTSKGAIRYQLYLGNGKIKRIKETKN

SEQ ID NO: 145 - DNA, 196 bp; double-stranded, linear
gggacaaattcaaaaaaataggcaagaggaagcaaaaatcttgcaaaaggaagaagtcttgagggtagctaagatggccctgcagacggggcaaaatcaggtaagcatcaacggagttgagattcaggtattttctagtgaaaaaggattggaggtctaccatggttcagaacagttgttggcaatcaaagagcca

SEQ ID NO: 146 - protein, 65 aa
GQIQKNRQEEAKILQKEEVLRVAKMALQTGQNQVSINGVEIQVFSSEKGLEVYHGSEQLLAIKEP

SEQ ID NO: 147 - DNA, 319 bp; double-stranded, linear
tcgctaccagcaacaaagcgagcaaaaggagtggctcttgtttgtggaccaacttgaggtagaattagaccgttcgcagttcgaaaaagtagaaggcaatcgcctatacatgaagcaagatggcaaggacatcgccatcggtaagtcaaagtcagatgatttccgtaaaacgaatgctcgtggtcgaggttatcagcctatggtttatggactcaaatctgtacggattacagaggacaatcaactggttcgctttcatttccagttccaaaaaggcttagaaagggagttcatctatcgtgtggaaaaagaaaaaagt

SEQ ID NO: 148 - protein, 106 aa
RYQQQSEQKEWLLFVDQLEVELDRSQFEKVEGNRLYMKQDGKDIAIGKSKSDDFRKTNARGRGYQPMVYGLKSVRITEDNQLVRFHFQFQKGLEREFIYRVEKEKS

SEQ ID NO: 149 - DNA, 322 bp; double-stranded, linear
gaaccgacaagtcgcccactatcaagactatgctttgaataaagaaaaattggttgcttttgctatggctaaacgaaccaaagataaggttgagcaagaaagtggggaacagttttttaatctaggtcaggtaagctatcaaaacaagaaaactggcttagtgacgagggttcgtacggataagagccaatatgagtttctgtttccttcagtcaaaatcaaagaagagaaaagagataaaaaggaagaggtagcgaccgattcaagcgaaaaagtggagaagaaaaaatcagaagagaagcctgaaaagaaagagaattca

SEQ ID NO: 150 - protein, 107 aa
NRQVAHYQDYALNKEKLVAFAMAKRTKDKVEQESGEQFFNLGQVSYQNKKTGLVTRVRTDKSQYEFLFPSVKIKEEKRDKKEEVATDSSEKVEKKKSEEKPEKKENS

SEQ ID NO: 151 - DNA, 784 bp; double-stranded, linear
ggttgtcggctggcaatatatcccgtttccatctaaaggtagtacaattggtccttacccaaatggtatcagattagaaggttttccaaagtcagagtggtactacttcgataaaaatggagtgctacaagagtttgttggttggaaaacattagagattaaaactaaagacagtgttggaagaaagtacggggaaaaacgtgaagattcagaagataaagaagagaagcgttattatacgaactattactttaatcaaaatcattctttagagacaggttggctttatgatcagtctaactggtattatctagctaagacggaaattaatggagaaaactaccttggtggtgaaagacgtgcggggtggataaacgatgattcgacttggtactacctagatccaacaactggtattatgcaaacaggttggcaatatctaggtaataagtggtactacctccgttcctcaggagcaatggccactggctggtatcaggaaggtaccacttggtattatttagaccacccaaatggcgatatgaaaacaggttggcaaaaccttgggaacaaatggtactatctccgttcatcaggagctatggcaactggttggtatcaagatggttcaacttggtactacctaaatgcaggtaatggagacatgaagacaggttggttccaggtcaatggcaactggtactatgcttatagctcaggtgctttggcagtgaatacgaccgtagatggctattctgtcaactataatggcgaatgggttcgg

SEQ ID NO: 152 - protein, 261 aa
VVGWQYIPFPSKGSTIGPYPNGIRLEGFPKSEWYYFDKNGVLQEFVGWKTLEIKTKDSVGRKYGEKREDSEDKEEKRYYTNYYFNQNHSLETGWLYDQSNWYYLAKTEINGENYLGGERRAGWINDDSTWYYLDPTTGIMQTGWQYLGNKWYYLRSSGAMATGWYQEGTTWYYLDHPNGDMKTGWQNLGNKWYYLRSSGAMATGWYQDGSTWYYLNAGNGDMKTGWFQVNGNWYYAYSSGALAVNTTVDGYSVNYNGEWVR

SEQ ID NO: 153 - DNA, 1708 bp; double-stranded, linear
ggccaaatcagaatgggtagaagacaagggagccttttattatcttgaccaagatggaaagatgaaaagaaatgcttgggtaggaacttcctatgttggtgcaacaggtgccaaagtaatagaagactgggtctatgattctcaatacgatgcttggttttatatcaaagcagatggacagcacgcagagaaagaatggctccaaattaaagggaaggactattatttcaaatccggtggttatctactgacaagtcagtggattaatcaagcttatgtgaatgctagtggtgccaaagtacagcaaggttggctttttgacaaacaataccaatcttggttttacatcaaagaaaatggaaactatgctgataaagaatggattttcgagaatggtcactattattatctaaaatccggtggctacatggcagccaatgaatggatttgggataaggaatcttggttttatctcaaatttgatgggaaaatggctgaaaaagaatgggtctacgattctcatagtcaagcttggtactacttcaaatccggtggttacatgacagccaatgaatggatttgggataaggaatcttggttttatctcaaatctgatgggaaaatagctgaaaaagaatgggtctacgattctcatagtcaagcttggtactacttcaaatccggtggttacatgacagccaatgaatggatttgggataaggaatcttggttttacctcaaatctgatgggaaaatagctgaaaaagaatgggtctacgattctcatagtcaagcttggtactacttcaaatctggtggctacatggcgaaaaatgagacagtagatggttatcagcttggaagcgatggtaaatggcttggaggaaaaactacaaatgaaaatgctgcttactatcaagtagtgcctgttacagccaatgtttatgattcagatggtgaaaagctttcctatatatcgcaaggtagtgtcgtatggctagataaggatagaaaaagtgatgacaagcgcttggctattactatttctggtttgtcaggctatatgaaaacagaagatttacaagcgctagatgctagtaaggactttatcccttattatgagagtgatggccaccgtttttatcactatgtggctcagaatgctagtatcccagtagcttctcatctttctgatatggaagtaggcaagaaatattattcggcagatggcctgcattttgatggttttaagcttgagaatcccttccttttcaaagatttaacagaggctacaaactacagtgctgaagaattggataaggtatttagtttgctaaacattaacaatagccttttggagaacaagggcgctacttttaaggaagccgaagaacattaccatatcaatgctctttatctccttgcccatagtgccctagaaagtaactggggaagaagtaaaattgccaaagataagaataatttctttggcattacagcctatgatacgaccccttacctttctgctaagacatttgatgatgtggataagggaattttaggtgcaaccaagtggattaaggaaaattatatcgataggggaagaactttccttggaaacaaggcttctggtatgaatgtggaatatgcttcagacccttattggggcgaaaaaattgctagtgtgatgatgaaaatcaatgagaag

SEQ ID NO: 154 - protein, 569 aa
AKSEWVEDKGAFYYLDQDGKMKRNAWVGTSYVGATGAKVIEDWVYDSQYDAWFYIKADGQHAEKEWLQIKGKDYYFKSGGYLLTSQWINQAYVNASGAKVQQGWLFDKQYQSWFYIKENGNYADKEWIFENGHYYYLKSGGYMAANEWIWDKESWFYLKFDGKMAEKEWVYDSHSQAWYYFKSGGYMTANEWIWDKESWFYLKSDGKIAEKEWVYDSHSQAWYYFKSGGYMTANEWIWDKESWFYLKSDGKIAEKEWVYDSHSQAWYYFKSGGYMAKNETVDGYQLGSDGKWLGGKTTNENAAYYQVVPVTANVYDSDGEKLSYISQGSVVWLDKDRKSDDKRLAITISGLSGYMKTEDLQALDASKDFIPYYESDGHRFYHYVAQNASIPVASHLSDMEVGKKYYSADGLHFDGFKLENPFLFKDLTEATNYSAEELDKVFSLLNINNSLLENKGATFKEAEEHYHINALYLLAHSALESNWGRSKIAKDKNNFFGITAYDTTPYLSAKTFDDVDKGILGATKWIKENYIDRGRTFLGNKASGMNVEYASDPYWGEKIASVMMKINEK

SEQ ID NO: 155 - DNA, 946 bp; double-stranded, linear
atttgcagatgattctgaaggatggcagtttgtccaagaaaatggtagaacctactacaaaaagggggatctaaaagaaacctactggagagtgatagatgggaagtactattattttgatcctttatccggagagatggttgtcggctggcaatatatacctgctccacacaagggggttacgattggtccttctccaagaatagagattgctcttagaccagattggttttattttggtcaagatggtgtattacaagaatttgttggcaagcaagttttagaagcaaaaactgctacgaataccaacaaacatcatggggaagaatatgatagccaagcagagaaacgagtctattattttgaagatcagcgtagttatcatactttaaaaactggttggatttatgaagagggtcattggtattatttacagaaggatggtggctttgattcgcgcatcaacagattgacggttggagagctagcacgtggttgggttaaggattaccctcttacgtatgatgaagagaagctaaaagcagctccatggtactatctaaatccagcaactggcattatgcaaacaggttggcaatatctaggtaatagatggtactacctccattcgtcaggagctatggcaactggctggtataaggaaggctcaacttggtactatctagatgctgaaaatggtgatatgagaactggctggcaaaaccttgggaacaaatggtactatctccgttcatcaggagctatggcaactggttggtatcaggaaagttcgacttggtactatctaaatgcaagtaatggagatatgaaaacaggctggttccaagtcaatggtaactggtactatgcctatgattcaggtgctttagctgttaataccacagtaggtggttactacttaaactataatggtgaatgggttaag

SEQ ID NO: 156 - protein, 316 aa
VFADDSEGWQFVQENGRTYYKKGDLKETYWRVIDGKYYYFDPLSGEMVVGWQYIPAPHKGVTIGPSPRIEIALRPDWFYFGQDGVLQEFVGKQVLEAKTATNTNKHHGEEYDSQAEKRVYYFEDQRSYHTLKTGWIYEEGHWYYLQKDGGFDSRINRLTVGELARGWVKDYPLTYDEEKLKAAPWYYLNPATGIMQTGWQYLGNRWYYLHSSGAMATGWYKEGSTWYYLDAENGDMRTGWQNLGNKWYYLRSSGAMATGWYQESSTWYYLNASNGDMKTGWFQVNGNWYYAYDSGALAVNTTVGGYYLNYNGEWVK

SEQ ID NO: 157 - DNA, 1415 bp; double-stranded, linear
tgtcgctgcaaatgaaactgaagtagcaaaaacttcgcaggatacaacgacagcttcaagtagttcagagcaaaatcagtcttctaataaaacgcaaacgagcgcagaagtacagactaatgctgctgcccactgggatggggattattatgtaaaggatgatggttctaaagctcaaagtgaatggatttttgacaactactataaggcttggttttatattaattcagatggtcgttactcgcagaatgaatggcatggaaattactacctgaaatcaggtggatatatggcccaaaacgagtggatctatgacagtaattacaagagttggttttatctcaagtcagatggggcttatgctcatcaagaatggcaattgattggaaataagtggtactacttcaagaagtggggttacatggctaaaagccaatggcaaggaagttatttcttgaatggtcaaggagctatgatgcaaaatgaatggctsctatgatccagcctattctgcttatttttatctaaaatccgatggaacttatgctaaccaagagtggcaaaaagtgggcggcaaatggtactatttcaagaagtggggctatatggctcggaatgagtggcaaggcaactactatttgactggaagtggtgccatggcgactgacgaagtgattatggatggtactcgctatatctttgcggcctctggtgagctcaaagaaaaaaaagatttgaatgtcggctgggttcacagagatggtaagcgctatttctttaataatagagaagaacaagtgggaaccgaacatgctaagaaagtcattgatattagtgagcacaatggtcgtatcaatgattggaaaaaggttattgatgagaacgaagtggatggtgtcattgttcgtctaggttatagcggtaaagaagacaaggaattggcgcataacattaaggagttaaaccgtctgggaattccttatggtgtctatctctatacctatgctgaaaatgagaccgatgctgagagtgacgctaaacagaccattgaacttataaagaaatacaatatgaacctgtcttaccctatctattatgatgttgagaattgggaatatgtaaataagagcaagagagctccaagtgatacaggcacttgggttaaaatcatcaacaagtacatggacacgatgaagcaggcgggttatcaaaatgtgtatgtctatagctatcgtagtttattacagacgcgtttaaaacacccagatattttaaaacatgtaaactgggtagcggcctatacgaatgctttagaatgggaaaaccctcattattcaggaaaaaaaggttggcaatatacctcttctgaatacatgaaaggaatccaagggcgcgtagatgtcagcgtttggtat

SEQ ID NO: 158 - protein, 471 aa
VAANETEVAKTSQDTTTASSSSEQNQSSNKTQTSAEVQTNAAAHWDGDYYVKDDGSKAQSEWIFDNYYKAWFYINSDGRYSQNEWHGNYYLKSGGYMAQNEWIYDSNYKSWFYLKSDGAYAHQEWQLIGNKWYYFKKWGYMAKSQWQGSYFLNGQGAMMQNEWLYDPAYSAYFYLKSDGTYANQEWQKVGGKWYYFKKWGYMARNEWQGNYYLTGSGAMATDEVIMDGTRYIFAASGELKEKKDLNVGWVHRDGKRYFFNNREEQVGTEHAKKVIDISEHNGRINDWKKVIDENEVDGVIVRLGYSGKEDKELAHNIKELNRLGIPYGVYLYTYAENETDAESDAKQTIELIKKYNMNLSYPIYYDVENWEYVNKSKRAPSDTGTWVKIINKYMDTMKQAGYQNVYVYSYRSLLQTRLKHPDILKHVNWVAAYTNALEWENPHYSGKKGWQYTSSEYMKGIQGRVDVSVWY

SEQ ID NO: 159 - DNA, 1924 bp; double-stranded, linear
tacgtctcagcctacttttgtaagagcagaagaatctccacaagttgtcgaaaaatcttcattagagaagaaatatgaggaagcaaaagcaaaagctgatactgccaagaaagattacgaaacggctaaaaagaaagcagaagacgctcagaaaaagtatgaagatgatcagaagagaactgaggagaaagctcgaaaagaagcagaagcatctcaaaaattgaatgatgtggcgcttgttgttcaaaatgcatataaagagtaccgagaagttcaaaatcaacgtagtaaatataaatctgacgctgaatatcagaaaaaattaacagaggtcgactctaaaatagagaaggctaggaaagagcaacaggacttgcaaaataaatttaatgaagtaagagcagttgtagttcctgaaccaaatgcgttggctgagactaagaaaaaagcagaagaagctaaagcagaagaaaaagtagctaagagaaaatatgattatgcaactctaaaggtagcactagcgaagaaagaagtagaggctaaggaacttgaaattgaaaaacttcaatatgaaatttctactttggaacaagaagttgctactgctcaacatcaagtagataatttgaaaaaacttcttgctggtgcggatcctgatgatggcacagaagttatagaagctaaattaaaaaaaggagaagctgagctaaacgctaaacaagctgagttagcaaaaaaacaaacagaacttgaaaaacttcttgacagccttgatcctgaaggtaagactcaggatgaattagataaagaagcagaagaagctgagttggataaaaaagctgatgaacttcaaaataaagttgctgatttagaaaaagaaattagtaaccttgaaatattacttggaggggctgatnctgaagatgatactgctgctcttcaaaataaattagctactaaaaaagctgaattggaaaaaactcaaaaagaattagatgcagctcttaatgagttaggccctgatggagatgaagaagaaactccagcgccggctcctcaaccagagcaaccagctcctgcaccaaaaccagagcaaccagctccagctccaaaaccagagcaaccagctcctgcaccaaaaccagagcaaccagctccagctccaaaaccagagcaaccagctccagctccaaaaccagagcaaccagctaagccggagaaaccagctgaagagcctactcaaccagaaaaaccagccactccaaaaacaggctggaaacaagaaaacggtatgtggtatttctacaatactgatggttcaatggcaataggttggctccaaaacaacggttcatggtactacctaaacgctaacggcgctatggcaacaggttgggtgaaagatggagatacctggtactatcttgaagcatcaggtgctatgaaagcaagccaatggttcaaagtatcagataaatggtactatgtcaacagcaatggcgctatggcgacaggctggctccaatacaatggctcatggtactacctcaacgctaatggtgatatggcgacaggatggctccaatacaacggttcatggtattacctcaacgctaatggtgatatggcgacaggatgggctaaagtcaacggttcatggtactacctaaacgctaacggtgctatggctacaggttgggctaaagtcaacggttcatggtactacctaaacgctaacggttcaatggcaacaggttgggtgaaagatggagatacctggtactatcttgaagcatcaggtgctatgaaagcaagccaatggttcaaagtatcagataaatggtactatgtcaatggcttaggtgcccttgcagtcaacacaactgtagatggctataaagtcaatgccaatggtgaatgggtt

SEQ ID NO: 160 - protein, 641 aa
TSQPTFVRAEESPQVVEKSSLEKKYEEAKAKADTAKKDYETAKKKAEDAQKKYEDDQKRTEEKARKEAEASQKLNDVALVVQNAYKEYREVQNQRSKYKSDAEYQKKLTEVDSKIEKARKEQQDLQNKFNEVRAVVVPEPNALAETKKKAEEAKAEEKVAKRKYDYATLKVALAKKEVEAKELEIEKLQYEISTLEQEVATAQHQVDNLKKLLAGADPDDGTEVIEAKLKKGEAELNAKQAELAKKQTELEKLLDSLDPEGKTQDELDKEAEEAELDKKADELQNKVADLEKEISNLEILLGGADXEDDTAALQNKLATKKAELEKTQKELDAALNELGPDGDEEETPAPAPQPEQPAPAPKPEQPAPAPKPEQPAPAPKPEQPAPAPKPEQPAPAPKPEQPAKPEKPAEEPTQPEKPATPKTGWKQENGMWYFYNTDGSMAIGWLQNNGSWYYLNANGAMATGWVKDGDTWYYLEASGAMKASQWFKVSDKWYYVNSNGAMATGWLQYNGSWYYLNANGDMATGWLQYNGSWYYLNANGDMATGWAKVNGSWYYLNANGAMATGWAKVNGSWYYLNANGSMATGWVKDGDTWYYLEASGAMKASQWFKVSDKWYYVNGLGALAVNTTVDGYKVNANGEWV

SEQ ID NO: 161 - DNA, 670 bp; double-stranded, linear
tggacaggtgaaaggtcatgctacatttgtgaaatccatgacaactgaaatgtaccaagaacaacagaaccattctctcgcctacaatcaacgcttggnttcgcaaaatcgcattgtagatccttttttggcggagggatatgaggtcaattaccaagtgtctgacgaccctgatgcagtctatggttacttgtctattccaagtttggaaatcatggagccggtttatttgggagcagattatcatcatttagggatgggcttggctcatgtggatggtacaccgctgcctctggatggtacagggattcgctcagtgattgctgggcaccgtgcagagccaagccatgtctttttccgccatttggatcagctaaaagttggagatgctctttattatgataatggccaggaaattgtagaatatcagatgatggacacagagattattttaccgtcggaatgggaaaaattagaatcggttagctctaaaaatatcatgaccttgataacctgcgatccgattcctacctttaataaacgcttattagtgaattttgaacgagtcgctgtttatcaaaaatcagatccacaaacagctgcagttgcgagggttgcttttacgaaagaaggacaatctgtatcgcgtgttgcaacctctcaatggttg

SEQ ID NO: 162 - protein, 223 aa
GQVKGHATFVKSMTTEMYQEQQNHSLAYNQRLXSQNRIVDPFLAEGYEVNYQVSDDPDAVYGYLSIPSLEIMEPVYLGADYHHLGMGLAHVDGTPLPLDGTGIRSVIAGHRAEPSHVFFRHLDQLKVGDALYYDNGQEIVEYQMMDTEIILPSEWEKLESVSSKNIMTLITCDPIPTFNKRLLVNFERVAVYQKSDPQTAAVARVAFTKEGQSVSRVATSQWL

SEQ ID NO: 163 - DNA, 784 bp; double-stranded, linear
gattgctcctttgaaggatttgagagaaaccatgttggaaattgcttctggtgctcaaaatcttcgtgccaaggaagttggtgcctatgaactgagagaagtaactcgccaatttaatgctatgttggatcagattgatcagttgatggtagctattcgtagccaggaagaaacgacccgtcagtaccaacttcaagccctttcgagccagattaatccacatttcctctataacactttggacaccatcatctggatggctgaatttcatgatagtcagcgagtggtgcaggtgaccaagtccttggcaacctatttccgcttggcgctcaatcaaggcaaggacttgatttgtctctctgacgaaatcaatcatgtccgccagtatctctttatccagaaacaacgctatggagataagctggaatacgaaattaatgaaaatgttgcctttgataatttagtcttacccaagctggtcctacaaccccttgtagaaaatgctctttaccatggcattaaggaaaaggaaggtcagggccatattaaactttctgtccagaaacaggattcgggattggtcatccgtattgaggatgatggcgttggcttccaagatgctggtgatagtagtcaaagtcaactcaaacgtgggggagttggtcttcaaaatgtcgatcaacggctcaaacttcattttggagccaattaccatatgaagattgattctagaccccaaaaagggacgaaagttgaaatatatataaatagaatagaaactagc

SEQ ID NO: 164 - protein, 261 aa
IAPLKDLRETMLEIASGAQNLRAKEVGAYELREVTRQFNAMLDQIDQLMVAIRSQEETTRQYQLQALSSQINPHFLYNTLDTIIWMAEFHDSQRVVQVTKSLATYFRLALNQGKDLICLSDEINHVRQYLFIQKQRYGDKLEYEINENVAFDNLVLPKLVLQPLVENALYHGIKEKEGQGHIKLSVQKQDSGLVIRIEDDGVGFQDAGDSSQSQLKRGGVGLQNVDQRLKLHFGANYHMKIDSRPQKGTKVEIYINRIETS

SEQ ID NO: 165 - DNA, 325 bp; double-stranded, linear
taggtcatatgggactttttttctacaacaaaataggctccataatatctataagggatttacccactacaaatattatagagccgaaaattcacatctaatatatgcagactactttgaaatgaaattaaaaaaattattaaaggatgacacaaaagtttttgaaaaatctacattcaaatttgtagaaggatataaaatatacctgacagaatctaaagaatctggaattaaacaaatggacaatgtcataaaatattttgagtttattgaatctaaaagtattgctttatattttcaaaaacgattaaatgagctgatagat

SEQ ID NO: 166 - protein, 108 aa
RSYGTFFLQQNRLHNIYKGFTHYKYYRAENSHLIYADYFEMKLKKLLKDDTKVFEKSTFKFVEGYKIYLTESKESGIKQMDNVIKYFEFIESKSIALYFQKRLNELID

SEQ ID NO: 167 - DNA, 238 bp; double-stranded, linear
caacgttgagaattatttgcgaatgtgtttggatagcattcagaatcagacgtatcaaaattttgagtgtttattaatcaatgatggctctccagatcattcatccaaaatatgtgaagaatttgtagagaaagattctcgtttcaaatattttgagaaagcaaacggcggtctttcatcagctcgtaacctaggtattgaatgttcgggggggggcgtacattacttttgtagactc

SEQ ID NO: 168 - protein, 79 aa
NVENYLRMCLDSIQNQTYQNFECLLINDGSPDHSSKICEEFVEKDSRFKYFEKANGGLSSARNLGIECSGGGVHYFCRL

SEQ ID NO: 169 - DNA, 742 bp; double-stranded, linear
ctactatcaatcaagttcttcagccattgaggccaccattgagggcaacagccaaacgaccatcagccagactagccactttattcagtcttatatcaaaaaactagaaaccacctcgactggtttgacccagcagacggatgttctggcctatgctgagaatcccagtcaagacaaggtcgagggaatccgagatttgtttttgaccatcttgaagtcagataaggacttgaaaactgttgtgctggtgaccaaatctggtcaggtcatttctacagatgacagtgtgcagatgaaaacttcctctgatatgatggctgaggattggtaccaaaaggccattcatcagggagctatgcctgttttgactccagctcgtaaatcagatagtcagtgggtcatttctgtcactcaagaacttgttgatgcaaagggagccaatcttggtgtgcttcgtttggatatttcttatgaaactctggaagcctatctcaatcaactccagttggggcagcagggctttgccttcattatcaatgaaaaccatgaatttgtctaccatcctcaacacacagtttatagttcgtctagcaaaatggaggctatgaaaccctacatcgatacaggtcagggttatactcctggtcacaaatcctacgtcagtcaagagaagattgcaggaactgattggacggtgcttggcgtgtcatcattggaaaagttagaccaggttcggagtcag

SEQ ID NO: 170 - protein, 247 aa
YYQSSSSAIEATIEGNSQTTISQTSHFIQSYIKKLETTSTGLTQQTDVLAYAENPSQDKVEGIRDLFLTILKSDKDLKTVVLVTKSGQVISTDDSVQMKTSSDMMAEDWYQKAIHQGAMPVLTPARKSDSQWVISVTQELVDAKGANLGVLRLDISYETLEAYLNQLQLGQQGFAFIINENHEFVYHPQHTVYSSSSKMEAMKPYIDTGQGYTPGHKSYVSQEKIAGTDWTVLGVSSLEKLDQVRSQ

SEQ ID NO: 171 - DNA, 1282 bp; double-stranded, linear
gacaaaaacattaaaacgtcctgaggttttatcacctgcagggactttagagaagctaaaggtagctgttcagtatggagcagatgctgtctttatcggtggtcaggcctatggtcttcgtagccgtgcgggaaactttactttcgaacagatggaagaaggcgtgcagtttgcggccaagtatggtgccaaggtctatgtagcggctaatatggttatgcacgaaggaaatgaagctggtgctggtgagtggttccgtaaactgcgtgatatcgggattgcagcagttatcgtatctgacccagccttgattatgattgcagtgactgaagcaccaggccttgaaatccacctttctacccaagccagtgccactaactatgaaacccttgagttctggaaagagctaggcttgactcgtgtcgttttagcgcgtgaggtttcaatggaagaattagctgagatccgcaaacgtacagatgttgaaattgaagcctttgtccatggagctatgtgtatttcatactctggacgttgtactctttcaaaccacatgagtatgcgtgatgccaaccgtggtggatgttctcagtcatgccgttggaaatacgacctttacgatatgccatttgggaaagaacgtaagagtttgcagggtgagattccagaagaattttcaatgtcagccgttgacatgtctatgattgaccanattccagatatgattgaaaatggtgtggacagtctaaaaatcgaaggacgtatgnagtctattcactangtatcaacagtaaccaactgctacaaggcggctgtggatgcctatcttgaaagtcctgaaaagtttgaagctatcaaacaagacttggtggacgagatgtggaaggttgcccaacgtgaactggctacaggattttactatggtacaccatctgaaaatgagcagttgtttggtgctcgtcgtaaaatccctgagtacaagtttgtcgctgaagtggtttcttatgatgatgcggcacaaacagcaactattcgtcaacgaaacgtcattaacgaaggggaccaagttgagttttatggtccaggtttccgtcattttgaaacctatattgaagatttgcatgatgctaaaggcaataaaatcgaccgcgctccaaatccaatggaactattgactattaaagtcccacaacctgttcaatcaggagacatggttcgagctcttaaagaggggcttatcaatctttataaggaagatggaaccagcgtcacagttcgtgct

SEQ ID NO: 172 - protein, 427 aa
TKTLKRPEVLSPAGTLEKLKVAVQYGADAVFIGGQAYGLRSRAGNFTFEQMEEGVQFAAKYGAKVYVAANMVMHEGNEAGAGEWFRKLRDIGIAAVIVSDPALIMIAVTEAPGLEIHLSTQASATNYETLEFWKELGLTRVVLAREVSMEELAEIRKRTDVEIEAFVHGAMCISYSGRCTLSNHMSMRDANRGGCSQSCRWKYDLYDMPFGKERKSLQGEIPEEFSMSAVDMSMIDXIPDMIENGVDSLKIEGRMXSIHXVSTVTNCYKAAVDAYLESPEKFEAIKQDLVDEMWKVAQRELATGFYYGTPSENEQLFGARRKIPEYKFVAEVVSYDDAAQTATIRQRNVINEGDQVEFYGPGFRHFETYIEDLHDAKGNKIDRAPNPMELLTIKVPQPVQSGDMVRALKEGLINLYKEDGTSVTVRA

SEQ ID NO: 173 - DNA, 778 bp; double-stranded, linear
ttctcaggagacctttaaaaatatcaccaatagcttctccatgcaaatcaatcgtcgcgtcaaccaaggaacgcctcgtggtgctgggaatatcaagggtgaagacatcaaaaaaatcaccgaaaacaaggccattgagtcttatgtcaaacgtatcaacgctatcggagatttgactggatatgacctgattgaaacgccagaaaccaagaagaatctcactgctgatcgtgccaagcgttttggaagtagcttgatgattacaggtgtcaatgactcctctaaagaagacaagtttgtctctggttcttataaactagtcgaaggagagcacttaaccaacgacgacaaggataaaatcctcttgcacaaggacttggcagccaaacacggctggaaagtaggggacaaggttaaactggactctaatatctacgatgcagataatgaaaaaggagccaaggaaacagttgaagtgacaatcaagggactctttgatggtcataataagtcagcagtaacctactcacaagaactttacgaaaacacagctattacagacattcacactgctgcaaaactttatggatacacagaagacacagccatttatggggacgcaaccttctttgtaacagcagacaagaacttggatgatgttatgaaagagttgaatggcatcagtggtatcaactggaagagctacacactcgtcaagagctcctctaactacccagctcttgagcaatctatctctggtatgtacaagatggccaac

SEQ ID NO: 174 - protein, 259 aa
SQETFKNITNSFSMQINRRVNQGTPRGAGNIKGEDIKKITENKAIESYVKRINAIGDLTGYDLIETPETKKNLTADRAKRFGSSLMITGVNDSSKEDKFVSGSYKLVEGEHLTNDDKDKILLHKDLAAKHGWKVGDKVKLDSNIYDADNEKGAKETVEVTIKGLFDGHNKSAVTYSQELYENTAITDIHTAAKLYGYTEDTAIYGDATFFVTADKNLDDVMKELNGISGINWKSYTLVKSSSNYPALEQSISGMYKMAN

SEQ ID NO: 175 - DNA, 694 bp; double-stranded, linear
agtaaatgcgcaatcaaattcattaatattaatagatgaacctgaaatctcacttcatccgagtgcaatctataaatttaaagagtttttacttcaagagtgtttaaataaaaaacatcaaattattatcactacacattctacacaacttataaaagattttcctagagaagccgtgaaacttttagtgaaaaacggagaaaaggtagatgttattgaaaatattgattatcaggatgcattttttgaattaggtgatgtgtatcattctaggaagatgatttatgttgaagatagactagctaaatatattctagagtttgttatcactcattcaggtagtgagaatcttaaacagaatttagtagtgagatatattcctggtggagcaaatcaaataatttgtaataatattttaaactcatcgtatttagattccgataaccattatttttggcttgatggagatcaaaacactaatgttagtgaatcaaataatttaatgaactatcttgaaaatggtgttgttatatcagataaaattcctgaatcagataataaaaatcttgatgatattataaaattgataangggatgtccaattaaatttaatgtttcaggtaataaagggcaaaaaaataatattgaattaattgcgaaacaaagaagctttatagattattgggctaaatac

SEQ ID NO: 176 - protein, 231 aa
VNAQSNSLILIDEPEISLHPSAIYKFKEFLLQECLNKKHQIIITTHSTQLIKDFPREAVKLLVKNGEKVDVIENIDYQDAFFELGDVYHSRKMIYVEDRLAKYILEFVITHSGSENLKQNLVVRYIPGGANQIICNNILNSSYLDSDNHYFWLDGDQNTNVSESNNLMNYLENGVVISDKIPESDNKNLDDIIKLIXGCPIKFNVSGNKGQKNNIELIAKQRSFIDYWAKY

SEQ ID NO: 177 - DNA, 550 bp; double-stranded, linear
ttaccgcgttcatcaagatgtcaaacaagtcatgacctatcaacccatggtgcgagaaatattgagtgaacaagacaccccagcaaacgaagagcttgtgcttgctatgatttatactgaaacaaaaggaaaagaaggcgatgttatgcagtctagtgagtctgcaagtggttccaccaacaccatcaatgataatgcctctagcattcggcaaggcattcaaactctgacaggcaatctctatctggcgcagaagaagggggtagatatctggacagctgttcaagcctataattttggacctgcctatatcgattttatcgcccaaaatggcaaggaaaataccctggctctagccaaacagtactctcgtgagactgttgcccccttgcttggtaataggactggaaagacttatagttatattcaccccatttccatttttcacggtgctgaactctatgtaaatggaggaaactattattattctagacaggtacgacttaacctttacatcatcaaatgtttcactctcttttcaacatctggc

SEQ ID NO: 178 - protein, 183 aa
YRVHQDVKQVMTYQPMVREILSEQDTPANEELVLAMIYTETKGKEGDVMQSSESASGSTNTINDNASSIRQGIQTLTGNLYLAQKKGVDIWTAVQAYNFGPAYIDFIAQNGKENTLALAKQYSRETVAPLLGNRTGKTYSYIHPISIFHGAELYVNGGNYYYSRQVRLNLYIIKCFTLFSTSG

SEQ ID NO: 179 - DNA, 334 bp; double-stranded, linear
gtggatgggctttaactatcttcgtattcgccgtgcggctaaaattgtggacaatgaggagtttgaagccttgattcgtacgggtcaattgattgatttgcgcgacccagcagaattccacagaaaacatatccttggtgcacgcaatattccttcaagtcagttgaaaactagtcttgcagcccttcgtaaagataaacctgtccttctctacgaaaaccaacgtgcgcaacgagttacaaatgcagctctttacttgaaaaaacaaggtttttctgagatttatatcctttcttatggcttggattcttggaaagggaaagtgaagactagc

SEQ ID NO: 180 - protein, 111 aa
WMGFNYLRIRRAAKIVDNEEFEALIRTGQLIDLRDPAEFHRKHILGARNIPSSQLKTSLAALRKDKPVLLYENQRAQRVTNAALYLKKQGFSEIYILSYGLDSWKGKVKTS

SEQ ID NO: 181 - DNA, 1342 bp; double-stranded, linear
actaaaccagcatcgttcgcaggaaaataaggacaataatcgtgtctcttatgtggatggcagccagtcaagtcagaaaagtgaaaacttgacaccagaccaggttagccagaaagaaggaattcaggctgagcaaattgtaatcaaaattacagatcagggctatgtaacgtcacacggtgaccactatcattactataatgggaaagttccttatgatgccctctttagtgaagaactcttgatgaaggatccaaactatcaacttaaagacgctgatattgtcaatgaagtcaagggtggttatatcatcaaggtcgatggaaaatattatgtctacctgaaagatgcagctcatgctgataatgttcgaactaaagatgaaatcaatcgtcaaaaacaagaacatgtcaaagataatgagaaggttaactctaatgttgctgtagcaaggtctcagggacgatatacgacaaatgatggttatgtctttaatccagctgatattatcgaagatacgggtaatgcttatatcgttcctcatggaggtcactatcactacattcccaaaagcgatttatctgctagtgaattagcagcagctaaagcacatctggctggaaaaaatatgcaaccgagtcagttaagctattcttcaacagctagtgacaataacacgcaatctgtagcaaaaggatcaactagcaagccagcaaataaatctgaaaatctccagagtcttttgaaggaactctatgattcacctagcgcccaacgttacagtgaatcagatggcctggtctttgaccctgctaagattatcagtcgtacaccaaatggagttgcgattccgcatggcgaccattaccactttattccttacagcaagctttctgccttagaagaaaagattgccagaatggtgcctatcagtggaactggttctacagtttctacaaatgcaaaacctaatgaagtagtgtctagtctaggcagtctttcaagcaatccttcttctttaacgacaagtaaggagctctcttcagcatctgatggttatatttttaatccaaaagatatcgttgaagaaacggctacagcttatattgtaagacatggtgatcatttccattacattccaaaatcaaatcaaattgggcaaccgactcttccaaacaatagtctagcaacaccttctccatctcttccaatcaatccaggaacttcacatgagaaacatgaagaagatggatacggatttgatgctaatcgtattatcgctgaagatgaatcaggttttgtcatgagtcacggagaccacaatcattatttcttcaagaag

SEQ ID NO: 182 - protein, 447 aa
LNQHRSQENKDNNRVSYVDGSQSSQKSENLTPDQVSQKEGIQAEQIVIKITDQGYVTSHGDHYHYYNGKVPYDALFSEELLMKDPNYQLKDADIVNEVKGGYIIKVDGKYYVYLKDAAHADNVRTKDEINRQKQEHVKDNEKVNSNVAVARSQGRYTTNDGYVFNPADIIEDTGNAYIVPHGGHYHYIPKSDLSASELAAAKAHLAGKNMQPSQLSYSSTASDNNTQSVAKGSTSKPANKSENLQSLLKELYDSPSAQRYSESDGLVFDPAKIISRTPNGVAIPHGDHYHFIPYSKLSALEEKIARMVPISGTGSTVSTNAKPNEVVSSLGSLSSNPSSLTTSKELSSASDGYIFNPKDIVEETATAYIVRHGDHFHYIPKSNQIGQPTLPNNSLATPSPSLPINPGTSHEKHEEDGYGFDANRIIAEDESGFVMSHGDHNHYFFKK

SEQ ID NO: 183 - DNA, 934 bp; double-stranded, linear
tgactaccttgaaatcccactttacagctatcttggtggattcaacactaaagttcttccaactccaatgatgaacatcatcaacggtggttctcactctgacgctccaatcgctttccaagagttcatgatcttgccagttggtgcgccaacatttaaagaagcccttcgttacggtgctgaaatcttccacgctcttaagaaaatccttaaatcacgtggtttggaaactgccgtaggtgacgaaggtggattcgctcctcgtttcgaaggaactgaagatggtgttgaaactatccttgctgcgattgaagctgctggatatgtaccaggtaaagacgtatttatcggatttgactgtgcttcatcagaattctacgataaagaacgtaaagtttacgactacactaaatttgaaggtgaaggtgctgctgttcgtacatctgcagaacaaatcgactaccttgaagaattggttaacaaatacccaatcatcactattgaagatggtatggatgaaaacgactgggatggttggaaagctcttactgaacgtcttggtaagaaagtacaacttgttggtgacgacttcttcgtaacaaacactgactaccttgcacgtggtatccaagaaggtgctgctaactcaatccttatcaaagttaaccaaatcggtactcttactgaaacttttgaagctatcgaaatggctaaagaagctggttacactgctgttgtatcacaccgttcaggtgaaactgaagattcaacaatcgctgatattgcagttgcaactaacgcaggacaaatcaagactggttcactttcacgtacagaccgcatcgctaaatacaaccaattgcttcgtatcgaagaccaacttggtgaagtagctgaatatcgtggattgaaatcattctacaaccttaaaaaa

SEQ ID NO: 184 - protein, 311 aa
DYLEIPLYSYLGGFNTKVLPTPMMNIINGGSHSDAPIAFQEFMILPVGAPTFKEALRYGAEIFHALKKILKSRGLETAVGDEGGFAPRFEGTEDGVETILAAIEAAGYVPGKDVFIGFDCASSEFYDKERKVYDYTKFEGEGAAVRTSAEQIDYLEELVNKYPIITIEDGMDENDWDGWKALTERLGKKVQLVGDDFFVTNTDYLARGIQEGAANSILIKVNQIGTLTETFEAIEMAKEAGYTAVVSHRSGETEDSTIADIAVATNAGQIKTGSLSRTDRIAKYNQLLRIEDQLGEVAEYRGLKSFYNLKK

SEQ ID NO: 185 - DNA, 541 bp; double-stranded, linear
tcgtatctttttttggagcaatgttcgcgtagaaggacattccatggatccgaccctagcggatggcgaaattctcttcgttgtaaaacaccttcctattgaccgttttgatatcgtggtggcccatgaggaagatggcaataaggacatcgtcaagcgcgtgattggaatgcctggcgacaccattcgttacgaaaatgataaactctacatcaatgacaaagaaacggacgagccttatctagcagactatatcaaacgcttcaaggatgacaaactccaaagcacttactcaggcaagggctttgaaggaaataaaggaactttctttagaagtatcgctcaaaaagctcaagccttcacagttgatgtcaactacaacaccaactttagctttactgttccagaaggagaataccttctcctcggagatgaccgcttggtttcgagcgacagccgccacgtaggtaccttcaaagcaaaagatatcacaggggaagctaaattccgcttatggccaatcacccgtatcggaacattt

SEQ ID NO: 186 - protein, 180 aa
RIFFWSNVRVEGHSMDPTLADGEILFVVKHLPIDRFDIVVAHEEDGNKDIVKRVIGMPGDTIRYENDKLYINDKETDEPYLADYIKRFKDDKLQSTYSGKGFEGNKGTFFRSIAQKAQAFTVDVNYNTNFSFTVPEGEYLLLGDDRLVSSDSRHVGTFKAKDITGEAKFRLWPITRIGTF

SEQ ID NO: 187 - DNA, 400 bp; double-stranded, linear
ggactctctcaaagatgtgaaagcaaatgctagcgacagcaagcctgcacaggacaagaaggatgcaaaacaaggaacggaagatagtaaggattcagataagatgactgaaacaaactcagttccggcaggagtgattgtggtcagtctacttgccctcctaggcgtgattgccttctggctgattcgccgtaagaaagagtcagaaatccagcaattaagcacggaattgatcaaggttctaggacagctagatgcagaaaaagcggataaaaaagtccttgccaaagcccaaaaccttctccaagaaacccttgatttcgtgaaagaagaaaatggctcagcagagacagaaactaaactagtagaggagcttaaagcaatccttgacaaactcaag

SEQ ID NO: 188 - protein, 133 aa
DSLKDVKANASDSKPAQDKKDAKQGTEDSKDSDKMTETNSVPAGVIVVSLLALLGVIAFWLIRRKKESEIQQLSTELIKVLGQLDAEKADKKVLAKAQNLLQETLDFVKEENGSAETETKLVEELKAILDKLK

SEQ ID NO: 189 - DNA, 1201 bp; double-stranded, linear
caagaaatcctatcatctcttccagaagcaaacagagacgaggggaattcagactcagttgattgaagaatcgcttagtcagcagactataatccagtccttcaatgctcaaacagaatttatccaaagattgcgtgaggctcatgacaactactcaggctattctcagtcagccatcttttattcttcaacggtcaatccttcgactcgctttgtaaatgcactcatttatgcccttttagctggagtaggagcttatcgtatcatgatgggttcagccttgaccgtcggtcgtttagtgacttttttgaactatgttcagcaatacaccaagccctttaacgatatttcttcagtgctagctgagttgcaaagtgctctggcttgcgtagagcgtatctatggagtcttagatagccctgaagtggctgaaacaggtaaggaagtcttgacgaccagtgaccaagttaagggagctatttcctttaaacatgtctcttttggctaccatcctgaaaaaattttgattaaggacttgtctatcgatattccagctggtagtaaggtagccatcgttggtccgacaggtgctggaaaatcaactcttatcaatctccttatgcgtttttatcccattagctcgggagatatcttgctggatgggcaatccatttatgattatacacgagtatcattgagacagcagtttggtatggtgcttcaagaaacctggctcacacaagggaccattcatgataatattgcctttggcaatcctgaagccagtcgagagcaagtaattgctgctgccaaagcagctaatgcagactttttcatccaacagttgccacagggatacgataccaagttggaaaatgctggagaatctctctctgtcggccaagctcagctcttgaccatagcccgagtctttctggctattccaaagattcttatcttagacgaggcaacttcttccattgatacacggacagaagtgctggtacaggatgcctttgcaaaactcatgaagggccgcacaagtttcatcattgctcaccgtttgtcaaccattcaggatgcggatttaattcttgtcttagtagatggtgatattgttgaatatggtaaccatcaagaactcatggatagaaagggtaagtattaccaaatgcaaaaagctgcggcttttagttctgaa

SEQ ID NO: 190 - protein, 400 aa
KKSYHLFQKQTETRGIQTQLIEESLSQQTIIQSFNAQTEFIQRLREAHDNYSGYSQSAIFYSSTVNPSTRFVNALIYALLAGVGAYRIMMGSALTVGRLVTFLNYVQQYTKPFNDISSVLAELQSALACVERIYGVLDSPEVAETGKEVLTTSDQVKGAISFKHVSFGYHPEKILIKDLSIDIPAGSKVAIVGPTGAGKSTLINLLMRFYPISSGDILLDGQSIYDYTRVSLRQQFGMVLQETWLTQGTIHDNIAFGNPEASREQVIAAAKAANADFFIQQLPQGYDTKLENAGESLSVGQAQLLTIARVFLAIPKILILDEATSSIDTRTEVLVQDAFAKLMKGRTSFIIAHRLSTIQDADLILVLVDGDIVEYGNHQELMDRKGKYYQMQKAAAFSSE

SEQ ID NO: 191 - DNA, 1033 bp; double-stranded, linear
acgaaatgcagggcagacagatgcctcgcaaattgaaaaggcggcagttagccaaggaggaaaagcagtgaaaaaaacagaaattagtaaagacgcagacttgcacgaaatttatctagctggaggttgtttctggggagtggaggaatatttctcacgtgttcccggggtgacggatgccgtttcaggctatgcaaatggtagaggagaaacaaccaagtacgaattgattaaccaaacaggtcatgcagaaaccgtccatgtcacctatgatgccaagcaaatttctctcaaggaaatcctgcttcactatttccgcattatcaatccaaccagcaaaaataaacaaggaaatgatgtggggacccagtaccgtactggtgtttattacacagatgacaaggatttggaagtgattaaccaagtctttgatgaggtggctaagaaatacgatcaacctctagcagttgaaaaggaaaacttgaagaattttgtggtggctgaggattaccatcaagactatctcaagaaaaatccaaatggctactgccatatcaatgttaatcaggcggcctatcctgtcattgatgccagcaaatatccaaaaccaagtgatgaggaattgaaaaagaccctgtcacctgaggagtatgcagttacccaggaaaatcaaacagaacgagctttctcaaaccgttactgggataaatttgaatccggtatctatgtggatatagcaactggggaacctctcttttcatcaaaagacaaatttgagtctggttgtggctggcctagttttacccaacccatcagtccagatgttgtcacctacaaggaagataagtcctacaatatgacgcgtatggaagtgcggagccgagtaggagattctcaccttgggcatgtctttacggatggtccacaggacaagggcggcttacgttactgtatcaatagcctctctatccgctttattcccaaagaccaaatggaagaaaaaggctacgcttatttactagattatgttgat

SEQ ID NO: 192 - protein, 344 aa
RNAGQTDASQIEKAAVSQGGKAVKKTEISKDADLHEIYLAGGCFWGVEEYFSRVPGVTDAVSGYANGRGETTKYELINQTGHAETVHVTYDAKQISLKEILLHYFRIINPTSKNKQGNDVGTQYRTGVYYTDDKDLEVINQVFDEVAKKYDQPLAVEKENLKNFVVAEDYHQDYLKKNPNGYCHINVNQAAYPVIDASKYPKPSDEELKKTLSPEEYAVTQENQTERAFSNRYWDKFESGIYVDIATGEPLFSSKDKFESGCGWPSFTQPISPDVVTYKEDKSYNMTRMEVRSRVGDSHLGHVFTDGPQDKGGLRYCINSLSIRFIPKDQMEEKGYAYLLDYVD

SEQ ID NO: 193 - DNA, 396 bp; double-stranded, linear
tgtatagtttttagcgcttgttcttctaattctgntaaaaatgaagaaaatacttctaaagagcatgcgcctgataaaatagttttagatcatgctttcggtcaaactatattagataaaaaacctgaaagagttgcaactattgcttggggaaatcatgatgtagcattagctttaggaatagttcctgttggattttcaaaagcaaattacggtgtaagtgctgataaaggagttttaccatggacagaagaaaaaatcaaagaactaaatggtaaagctaacctatttgacgatttggatggacttaactttgaagcaatatcaaattctaaaccagatgttatcttagcaggttattctggtataactaaagaagattatgacactctatca

SEQ ID NO: 194 - protein, 132 aa
CIVFSACSSNSXKNEENTSKEHAPDKIVLDHAFGQTILDKKPERVATIAWGNHDVALALGIVPVGFSKANYGVSADKGVLPWTEEKIKELNGKANLFDDLDGLNFEAISNSKPDVILAGYSGITKEDYDTLS

SEQ ID NO: 195 - DNA, 844 bp; double-stranded, linear
gtgtgtcgagcatattctgaagcaaacctatcaaaatatagaaattattttagttgatgacggttctacggataattctggggaaatttgtgatgcttttatgatgcaagataatcgtgtgcgagtattgcatcaagaaaataaggggggggcagcacaagctaaaaatatggggattagtgtagctaagggagagtacatcacgattgttgattcagatgatatcgtaaaagaaaatatgattgaaactctttatcagcaagtccaagaaaaggatgcagatgttgttatagggaattactataattatgacgaaagtgacgggaatttttatttttatgtaacagggcaagatttttgcgtcgaagaattagctatacaagaaattatgaaccgtcaagcaggagattggaaattcaatagctcggcctttatattgccgacatttaagttgattaaaaaagaattattcaatgaagttcacttttcaaatggtcgccgctttgatgatgaagcaactatgcatcgcttttatcttttagcctctaaaatcgtctttataaacgataatctctatctgtatagaagacgttcaggaagcatcatgagaacggaatttgatctttcctgggcaagagatattgttgaagtgttttctaagaaaatatcggattgtgtcttggctggtttggatgtctccgttctgcgtattcgatttgtcaatcttttaaaagattataagcaaactttagaataccatcaattaacagatactgaggaatataaagatatttgtttcagattaaagttgttttttgatgcagaacaaagaaatggtaaaagt

SEQ ID NO: 196 - protein, 281 aa
CVEHILKQTYQNIEIILVDDGSTDNSGEICDAFMMQDNRVRVLHQENKGGAAQAKNMGISVAKGEYITIVDSDDIVKENMIETLYQQVQEKDADVVIGNYYNYDESDGNFYFYVTGQDFCVEELAIQEIMNRQAGDWKFNSSAFILPTFKLIKKELFNEVHFSNGRRFDDEATMHRFYLLASKIVFINDNLYLYRRRSGSIMRTEFDLSWARDIVEVFSKKISDCVLAGLDVSVLRIRFVNLLKDYKQTLEYHQLTDTEEYKDICFRLKLFFDAEQRNGKS

SEQ ID NO: 197 - DNA, 811 bp; double-stranded, linear
gtgtttggatagcattcagaatcagacgtatcaaaattttgagtgtttattaatcaatgatggctctccagatcattcatccaaaatatgtgaagaatttgtagagaaagattctcgtttcaaatattttgagaaagcaaacggcggtctttcatcagctcgtaacctaggtattgaatgttcggggggggcgtacattacttttgtagactctgatgattggttggaacatgatgctttagaccgattatatggtgctttgaaaaaggaaaacgcagatattagtatcgggcgttataattcttatgatgaaacacgctatgtgtatatgacttatgttacggatccagatgattctctagaagtgatagaaggtaaagcaattatggatagggaaggtgtcgaagaagtcagaaatgggaactggactgtagctgtcttgaagttattcaagagagagttactacaagatttaccatttcctataggaaaaattgcagaggatacttactggacatggaaggtacttctaagagcttcgaggatagtctatttgaatcgttgtgtttactggtaccgtgttggtttatctgatactttatcgaatacatggagtgaaaagcgtatgtatgatgaaattggggctagggaagaaaagatagctattttagcaagttcagactatgacttgaccaatcatattttgatttataaaaatagattacaaagagtgatagcaaaattagaagaacaaaatatgcagttcacagagatttacagaagaatgatggaaaaattgtctttacttccg

SEQ ID NO: 198 - protein, 270 aa
CLDSIQNQTYQNFECLLINDGSPDHSSKICEEFVEKDSRFKYFEKANGGLSSARNLGIECSGGAYITFVDSDDWLEHDALDRLYGALKKENADISIGRYNSYDETRYVYMTYVTDPDDSLEVIEGKAIMDREGVEEVRNGNWTVAVLKLFKRELLQDLPFPIGKIAEDTYWTWKVLLRASRIVYLNRCVYWYRVGLSDTLSNTWSEKRMYDEIGAREEKIAILASSDYDLTNHILIYKNRLQRVIAKLEEQNMQFTEIYRRMMEKLSLLP

SEQ ID NO: 199 - DNA, 2023 bp; double-stranded, linear
gtgcctagatagtattattactcaaacatataaaaatattgagattgttgtcgttaatgatggttctacggatgcttcaggtgaaatttgtaaagaattttcagaaatggatcaccgaattctctatatagaacaagaaaatgctggtctttctgccgcacgaaacaccggtctgaataatatgtccggaaattatgtgacctttgtggactcggatgattggattgagcaagattatgtagaaactctatataaaaaaatagtagagtatcaggctgatattgcagttggtaattattattctttcaacgaaagtgaaggaatgttctactttcatatattgggagactcctattatgagaaagtatatgataatgtttctatctttgagaacttgtatgaaactcaagaaatgaagagttttgctttgatatctgcttggggtaaactctataaggcaagattgtttgagcagttgcgctttgacataggtaaattaggagaagatggttacctcaatcaaaaggtatatttattatcagaaaaggtaatttatttaaataaaagtctttatgcttatcggattagaaaaggtagtttatcaagagtttggacagaaaagtggatgcacgctttagttgatgctatgtctgaacgtattacgctactagctaatatgggttatcctctagagaaacacttggcagtttatcgtcagatgttggaagtcagtctcgccaacggtcaagctagtggtttatctgacacagcaacgtataaagagtttgaaatgaaacaaaggcttttaaatcagctatcgagacaagaggaaagtgaaaagaaagccattgtcctcgcagcaaactatggctatgtagaccaagttttaacgacaatcaagtctatttgttatcataatcgttcgattcgtttttatctgattcatagcgattttccaaatgaatggattaagcaattaaataagcgcttagagaagtttgactcagaaattattaattgtcgggtaacttctgagcaaatttcatgttataaatcggatattagttacacagtctttttacgctatttcatagctgatttcgtgcaagaagacaaggccctctacttggactgtgatctagttgtaacgaaaaatctggatgacttgtttgctacagacttacaagattatcctttggctgctgttagagattttgggggcagagcttattttggtcaagaaatctttaatgccggtgttctcttggtaaacaatgctttttggaaaaaagagaatatgacccaaaaattaattgatgtaaccaatgaatggcatgataaggtggatcaggcagatcagagcatcttgaatatgctttttgaacataaatggttggaattggactttgattataatcatattgtcattcataaacagtttgctgattatcaattgcctgagggtcaggattatcctgctattattcactatctttctcatcggaaaccgtggaaagatttggcggcccaaacctatcgtgaagtttggtggtactatcatgggcttgaatggacagaattgggacaaaaccatcatttacatccattacaaagatctcacatctatccaataaaggaacctttcacttgtctaatctatactgcctcagaccatattgaacaaattgagacattggttcaatccttgcctgatattcagtttaagatagcagctagagtaatagttagtgatcgattggctcagatgacaatttatccaaacgtgactatatttaacggaattcactatttggtagatgtcgataatgaattggtagaaaccagtcaagtacttttagatattaatcatggcgaaaagacagaagaaattctcgatcaatttgctaatcttggcaagcctatcttatcctttgaaaatactaaaacctatgaagtaggtcaggaggcatatgctgttgaccaagttcaagcaatgattgaaaaattgagagaaataagcaaa

SEQ ID NO: 200 - protein, 674 aa
CLDSIITQTYKNIEIVVVNDGSTDASGEICKEFSEMDHRILYIEQENAGLSAARNTGLNNMSGNYVTFVDSDDWIEQDYVETLYKKIVEYQADIAVGNYYSFNESEGMFYFHILGDSYYEKVYDNVSIFENLYETQEMKSFALISAWGKLYKARLFEQLRFDIGKLGEDGYLNQKVYLLSEKVIYLNKSLYAYRIRKGSLSRVWTEKWMHALVDAMSERITLLANMGYPLEKHLAVYRQMLEVSLANGQASGLSDTATYKEFEMKQRLLNQLSRQEESEKKAIVLAANYGYVDQVLTTIKSICYHNRSIRFYLIHSDFPNEWIKQLNKRLEKFDSEIINCRVTSEQISCYKSDISYTVFLRYFIADFVQEDKALYLDCDLVVTKNLDDLFATDLQDYPLAAVRDFGGRAYFGQEIFNAGVLLVNNAFWKKENMTQKLIDVTNEWHDKVDQADQSILNMLFEHKWLELDFDYNHIVIHKQFADYQLPEGQDYPAIIHYLSHRKPWKDLAAQTYREVWWYYHGLEWTELGQNHHLHPLQRSHIYPIKEPFTCLIYTASDHIEQIETLVQSLPDIQFKIAARVIVSDRLAQMTIYPNVTIFNGIHYLVDVDNELVETSQVLLDINHGEKTEEILDQFANLGKPILSFENTKTYEVGQEAYAVDQVQAMIEKLREISK

SEQ ID NO: 201 - DNA, 910 bp; double-stranded, linear
cattcagaagcagacctatcaaaatctggaaattattcttgttgatgatggtgcaacagatgaaagtggtcgcttgtgtgattcaatcgctgaacaagatgacagggtgtcagtgcttcataaaaagaacgaaggattgtcgcaagcacgaaatgatgggatgaagcaggctcacggggattatctgatttttattgactcagatgattatatccatccagaaatgattcagagcttatatgagcaattagttcaagaagatgcggatgtttcgagctgtggtgtcatgaatgtctatgctaatgatgaaagcccacagtcagccaatcaggatgactattttgtctgtgattctcaaacatttctaaaggaatacctcataggtgaaaaaatacctgggacgatttgcaataagctaatcaagagacagattgcaactgccctatcctttcctaaggggttgatttacgaagatgcctattaccattttgatttaatcaagttggccaagaagtatgtggttaatactaaaccctattattactatttccatagaggggatagtattacgaccaaaccctatgcagagaaggatttagcctatattgatatctaccaaaagttttataatgaagttgtgaaaaactatcctgacttgaaagaggtcgcttttttcagattggcctatgcccacttctttattctggataagatgttgctagatgatcagtataaacagtttgaagcctattctcagattcatcgttttttaaaaggccatgcctttgctatttctaggaatccaattttccgtaaggggagaagaattagtgctttggccctattcataaatatttccttatatcgattcttattactgaaaaatattgaaaaatctaaaaaattacat

SEQ ID NO: 202 - protein, 303 aa
IQKQTYQNLEIILVDDGATDESGRLCDSIAEQDDRVSVLHKKNEGLSQARNDGMKQAHGDYLIFIDSDDYIHPEMIQSLYEQLVQEDADVSSCGVMNVYANDESPQSANQDDYFVCDSQTFLKEYLIGEKIPGTICNKLIKRQIATALSFPKGLIYEDAYYHFDLIKLAKKYVVNTKPYYYYFHRGDSITTKPYAEKDLAYIDIYQKFYNEVVKNYPDLKEVAFFRLAYAHFFILDKMLLDDQYKQFEAYSQIHRFLKGHAFAISRNPIFRKGRRISALALFINISLYRFLLLKNIEKSKKLH

SEQ ID NO: 203 - DNA, 1972 bp; double-stranded, linear
taaggctgataatcgtgttcaaatgagaacgacgattaataatgaatcgccattgttgctttctccgttgtatggcaatgataatggtaacggattatggtgggggaacacattgaagggagcatgggaagctattcctgaagatgtaaagccatatgcagcgattgaacttcatcctgcaaaagtctgtaaaccaacaagttgtattccacgagatacgaaagaattgagagaatggtatgtcaagatgttggaggaagctcaaagtctaaacattccagttttcttggttattatgtcggctggagagcgtaatacagttcctccagagtggttagatgaacaattccaaaagtatagtgtgttaaaaggtgttttaaatattgagaattattggatttacaataaccagttagctccgcatagtgctaaatatttggaagtttgtgccaaatatggagcgcattttatctggcatgatcatgaaaaatggttctgggaaactattatgaatgatccgacattctttgaagcgagtcaaaaatatcataaaaatttggtgttggcaactaaaaatacgccaataagagatgatgcgggtacagattctatcgttagtggattttggttgagtggcttatgtgataactggggctcatcaacagatacatggaaatggtgggaaaaacattatacaaacacatttgaaactggaagagctagggatatgagatcctatgcatcggaaccagaatcaatgattgctatggaaatgatgaatgtatatactgggggaggcacagtttataatttcgaatgtgccgcgtatacatttatgacaaatgatgtaccaactccagcatttactaaaggtattattcctttctttagacatgctatacaaaatccagctccaagtaaggaagaagttgtaaatagaacaaaagctgtattttggaatggagaaggtaggattagttcattaaacggattttatcaaggactttattcgaatgatgaaacaatgcctttatataataatgggagatatcatattcttcctgtaatacatgagaaaattgataaggaaaagatttcatctatattccctaatgcaaaaattttgactaaaaatagtgaggaattgtctagtaaagtcaactatttaaactcgctttatccaaaactttatgaaggagatgggtatgctcagcgtgtaggtaattcctggtatatttataatagtaatgctaatatcaataaaaatcagcaagtaatgttgcctatgtatactaataatacaaagtcgttatcgttagatttgacgccacatacttacgctgttgttaaagaaaatccaaataatttacatattttattgaataattacaggacagataagacagctatgtgggcattatcaggaaattttgatgcatcaaaaagttggaagaaagaagaattagagttagcgaactggataagcaaaaattattccatcaatcctgtagataatgactttaggacaacaacacttacattaaaagggcatactggtcataaacctcagataaatataagtggcgataaaaatcattatacttatacagaaaattgggatgagaatacccatgtttataccattacggttaatcataatggaatggtagagatgtctataaatactgaggggacaggtccagtctctttcccaacaccagataaatttaatgatggtaatttgaatatagcatatgcaaaaccaacaacacaaagttctgtagattacaatggagaccctaatagagctgtggatggtaacagaaatggtaattttaactctggttcggtaacacacactagggcagataatccctcttggtgggaagtcgatttgaaaaaaatggataaagttgggcttgttaaaatttataatcgcacagatgctgagactcaacgtctatctaatttt

SEQ ID NO: 204 - protein, 657 aa
KADNRVQMRTTINNESPLLLSPLYGNDNGNGLWWGNTLKGAWEAIPEDVKPYAAIELHPAKVCKPTSCIPRDTKELREWYVKMLEEAQSLNIPVFLVIMSAGERNTVPPEWLDEQFQKYSVLKGVLNIENYWIYNNQLAPHSAKYLEVCAKYGAHFIWHDHEKWFWETIMNDPTFFEASQKYHKNLVLATKNTPIRDDAGTDSIVSGFWLSGLCDNWGSSTDTWKWWEKHYTNTFETGRARDMRSYASEPESMIAMEMMNVYTGGGTVYNFECAAYTFMTNDVPTPAFTKGIIPFFRHAIQNPAPSKEEVVNRTKAVFWNGEGRISSLNGFYQGLYSNDETMPLYNNGRYHILPVIHEKIDKEKISSIFPNAKILTKNSEELSSKVNYLNSLYPKLYEGDGYAQRVGNSWYIYNSNANINKNQQVMLPMYTNNTKSLSLDLTPHTYAVVKENPNNLHILLNNYRTDKTAMWALSGNFDASKSWKKEELELANWISKNYSINPVDNDFRTTTLTLKGHTGHKPQINISGDKNHYTYTENWDENTHVYTITVNHNGMVEMSINTEGTGPVSFPTPDKFNDGNLNIAYAKPTTQSSVDYNGDPNRAVDGNRNGNFNSGSVTHTRADNPSWWEVDLKKMDKVGLVKIYNRTDAETQRLSNF

SEQ ID NO: 205 - DNA, 811 bp; double-stranded, linear
ctgtggcaatcagtcagctgcttccaaacagtcagcttcaggaacgattgaggtgatttcacgagaaaatggctctgggacacggggtgccttcacagaaatcacagggattctcaaaaaagacggtgataaaaaaattgacaacactgccaaaacagctgtgattcaaaatagtacagaaggtgttctctcagcagttcaagggaatgctaatgctatcggctacatctccttgggatctttaacgaaatctgtcaaggctttagagattgatggtgtcaaggctagtcgagacacagttttagatggtgaataccctcttcaacgtcccttcaacattgtttggtcttctaatctttccaagctaggtcaagattttatcagctttatccactccaaacaaggtcaacaagtggtcacagataataaatttattgaagctaaaaccgaaaccacggaatatacaagccaacacttatcaggcaagttgtctgttgtaggttccacttcagtatcttctttaatggaaaaattagcagaagcttataaaaaagaaaatccagaagttacgattgatattacctctaatgggtcttcagcaggtattaccgctgttaaggagaaaaccgctgatattggtatggtttctagggaattaactcctgaagaaggtaagagtctcacccatgatgctattgctttagacggtattgctgttgtggtcaataatgacaataaggcaagccaagtcagtatggctgaacttgcagacgtttttagtggcaaattaaccacctgggacaagattaaa

SEQ ID NO: 206 - protein, 270 aa
CGNQSAASKQSASGTIEVISRENGSGTRGAFTEITGILKKDGDKKIDNTAKTAVIQNSTEGVLSAVQGNANAIGYISLGSLTKSVKALEIDGVKASRDTVLDGEYPLQRPFNIVWSSNLSKLGQDFISFIHSKQGQQVVTDNKFIEAKTETTEYTSQHLSGKLSVVGSTSVSSLMEKLAEAYKKENPEVTIDITSNGSSAGITAVKEKTADIGMVSRELTPEEGKSLTHDAIALDGIAVVVNNDNKASQVSMAELADVFSGKLTTWDKIK

SEQ ID NO: 207 - DNA, 805 bp; double-stranded, linear
ttgtcaacaacaacatgctacttctgaggggacgaatcaaaggcaaagcagttcagcgaaagttccatggaaagcttcatacaccaacctaaacaaccaggtaagtacagaagaggtcaaatctctcttatcagctcacttggatccaaatagtgttgatgcattttttaatctcgttaatgactataataccattgtcggctcaactggcttatcaggagatttcacttcctttactcacaccgaatacgatgttgagaaaatcagtcatctctggaatcaaaagaagggcgattttgttgggaccaactgccgtatcaatagttattgtcttttgaaaaattcagtcaccattccaaagcttgaaaagaatgaccagttgcttttcctagataatgatgcgattgataaaggaaaggtctttgattcacaagataaggaagagtttgatattctattttcgagagttccaactgagtcaactacagatgtcaaggttcacgctgaaaagatggaagcattcttctcacaatttcaattcaatgaaaaagctcgaatgctgtctgtagtcttgcacgacaatttggatggcgagtatctgtttgtaggccacgttggggtcttagtacctgctgatgacggtttcttatttgtagagaaattgactttcgaagagccctaccaagcgattaaatttgctagtaaggaagattgctacaagtatttgggcaccaagtatgcggattatacaggcgagggactggctaagccttttatcatggataatgataagtgggttaaactt

SEQ ID NO: 208 - protein, 268 aa
CQQQHATSEGTNQRQSSSAKVPWKASYTNLNNQVSTEEVKSLLSAHLDPNSVDAFFNLVNDYNTIVGSTGLSGDFTSFTHTEYDVEKISHLWNQKKGDFVGTNCRINSYCLLKNSVTIPKLEKNDQLLFLDNDAIDKGKVFDSQDKEEFDILFSRVPTESTTDVKVHAEKMEAFFSQFQFNEKARMLSVVLHDNLDGEYLFVGHVGVLVPADDGFLFVEKLTFEEPYQAIKFASKEDCYKYLGTKYADYTGEGLAKPFIMDNDKWVKL

SEQ ID NO: 209 - DNA, 508 bp; double-stranded, linear
ttgttcaggcaagtccgtgactagtgaacaccaaacgaaagatgaaatgaagacggagcagacagctagtaaaacaagcgcagctaaagggaaagaggtggctgattttgaattgatgggagtagatggcaagacctaccgtttatctgattacaagggcaagaaagtctatctcaaattctgggcttcttggtgttccatctgtctggctagtcttccagatacggatgagattgctaaagaagctggtgatgactatgtggtcttgacagtagtgtcaccaggacataagggagagcaatctgaagcggactttaagaattggtataagggattggattataaaaatctcccagtcctagttgacccatcaggcaaacttttggaaacttatggtgtccgttcttacccaacccaagcctttatagacaaagaaggcaagctggtcaaaacacatccaggattcatggaaaaagatgcaattttgcaaactttgaaggaattagcc

SEQ ID NO: 210 - protein, 169 aa
CSGKSVTSEHQTKDEMKTEQTASKTSAAKGKEVADFELMGVDGKTYRLSDYKGKKVYLKFWASWCSICLASLPDTDEIAKEAGDDYVVLTVVSPGHKGEQSEADFKNWYKGLDYKNLPVLVDPSGKLLETYGVRSYPTQAFIDKEGKLVKTHPGFMEKDAILQTLKELA

SEQ ID NO: 211 - DNA, 994 bp; double-stranded, linear
ctcgcaaattgaaaaggcggcagttagccaaggaggaaaagcagtgaaaaaaacagaaattagtaaagacgcagacttgcacgaaatttatctagctggaggttgtttctggggagtggaggaatatttctcacgtgttcccggggtgacggatgccgtttcaggctatgcaaatggtagaggagaaacaaccaagtacgaattgattaaccaaacaggtcatgcagaaaccgtccatgtcacctatgatgccaagcaaatttctctcaaggaaatcctgcttcactatttccgcattatcaatccaaccagcaaaaataaacaaggaaatgatgtggggacccagtaccgtactggtgtttattacacagatgacaaggatttggaagtgattaaccaagtctttgatgaggtggctaagaaatacgatcaacctctagcagttgaaaaggaaaacttgaagaattttgtggtggctgaggattaccatcaagactatctcaagaaaaatccaaatggctactgccatatcaatgttaatcaggcggcctatcctgtcattgatgccagcaaatatccaaaaccaagtgatgaggaattgaaaaagaccctgtcacctgaggagtatgcagttacccaggaaaatcaaacagaacgagctttctcaaaccgttactgggataaatttgaatccggtatctatgtggatatagcaactggggaacctctcttttcatcaaaagacaaatttgagtctggttgtggctggcctagttttacccaacccatcagtccagatgttgtcacctacaaggaagataagtcctacaatatgacgcgtatggaagtgcggagccgagtaggagattctcaccttgggcatgtctttacggatggtccacaggacaagggcggcttacgttactgtatcaatagcctctctatccgctttattcccaaagaccaaatggaagaaaaaggtacgcttatttac

SEQ ID NO: 212 - protein, 331 aa
SQIEKAAVSQGGKAVKKTEISKDADLHEIYLAGGCFWGVEEYFSRVPGVTDAVSGYANGRGETTKYELINQTGHAETVHVTYDAKQISLKEILLHYFRIINPTSKNKQGNDVGTQYRTGVYYTDDKDLEVINQVFDEVAKKYDQPLAVEKENLKNFVVAEDYHQDYLKKNPNGYCHINVNQAAYPVIDASKYPKPSDEELKKTLSPEEYAVTQENQTERAFSNRYWDKFESGIYVDIATGEPLFSSKDKFESGCGWPSFTQPISPDVVTYKEDKSYNMTRMEVRSRVGDSHLGHVFTDGPQDKGGLRYCINSLSIRFIPKDQMEEKGTLIY

SEQ ID NO: 213 - DNA, 625 bp; double-stranded, linear
ttgtcagtcaggttctaatggttctcagtctgctgtggatgctatcaaacaaaaagggaaattagttgtggcaaccagtcctgactatgcaccctttgaatttcaatcattggttgatggaaagaaccaggtagtcggtgcagacatcgacatggctcaggctatcgctgatgaacttggggttaagttggaaatctcaagcatgagttttgacaatgttttgaccagtcttcaaactggtaaggctgacctagcagttgcaggaattagtgctactgacgagagaaaagaagtctttgatttttcaatcccatactatgaaaacaagattagtttcttggttcgtaaggctgatgtggaaaaatacaaggatttaactagcctagaaagtgctaatattgcagcccaaaaagggactgttccagaatcaatggtcaaggaacaattgccaaaagttcaattaacttccctaactaatatgggtgaagcagtcaatgaattgcaggctggaaaaatagatgctgttcatatggatgagcctgttgcacttagttatgctgctaaaaacgctggcttagctgtcgcaactgtcagcttgaagatgaaggacggcgacgccaatgcc

SEQ ID NO: 214 - protein, 208 aa
CQSGSNGSQSAVDAIKQKGKLVVATSPDYAPFEFQSLVDGKNQVVGADIDMAQAIADELGVKLEISSMSFDNVLTSLQTGKADLAVAGISATDERKEVFDFSIPYYENKISFLVRKADVEKYKDLTSLESANIAAQKGTVPESMVKEQLPKVQLTSLTNMGEAVNELQAGKIDAVHMDEPVALSYAAKNAGLAVATVSLKMKDGDANA

SEQ ID NO: 215 - DNA, 3022 bp; double-stranded, linear
ggaaacttcacaggattttaaagagaagaaaacagcagtcattaaggaaaaagaagttgttagtaaaaatcctgtgatagacaataacactagcaatgaagaagcaaaaatcaaagaagaaaattccaataaatcccaaggagattatacggactcatttgtgaataaaaacacagaaaatcccaaaaaagaagataaagttgtctatattgctgaatttaaagataaagaatctggagaaaaagcaatcaaggaactatccagtcttaagaatacaaaagttttatatacttatgatagaatttttaacggtagtgccatagaaacaactccagataacttggacaaaattaaacaaatagaaggtatttcatcggttgaaagggcacaaaaagtccaacccatgatgaatcatgccagaaaggaaattggagttgaggaagctattgattacctaaagtctatcaatgctccgtttgggaaaaattttgatggtagaggtatggtcatttcaaatatcgatactggaacagattatagacataaggctatgagaatcgatgatgatgccaaagcctcaatgagatttaaaaaagaagacttaaaaggcactgataaaaattattggttgagtgataaaatccctcatgcgttcaattattataatggtggcaaaatcactgtagaaaaatatgatgatggaagggattattttgacccacatgggatgcatattgcagggattcttgctggaaatgatactgaacaagacatcaaaaactttaacggcatagatggaattgcacctaatgcacaaattttctcttacaaaatgtattctgacgcaggatctgggtttgcgggtgatgaaacaatgtttcatgctattgaagattctatcaaacacaacgttgatgttgtttcggtatcatctggttttacaggaacaggtcttgtaggtgagaaatattggcaagctattcgggcattaagaaaagcaggcattccaatggttgtcgctacgggtaactatgcgacttctgcttcaagttcttcatgggatttagtagcaaataatcatctgaaaatgaccgacactggaaatgtaacacgaactgcagcacatgaagatgcgatagcggtcgcttctgctaaaaatcaaacagttgagtttgataaagttaacataggtggagaaagttttaaatacagaaatataggggcctttttcgataagagtaaaatcacaacaaatgaagatggaacaaaagctcctagtaaattaaaatttgtatatataggcaaggggcaagaccaagatttgataggtttggatcttaggggcaaaattgcagtaatggatagaatttatacaaaggatttaaaaaatgcttttaaaaaagctatggataagggtgcacgcgccattatggttgtaaatactgtaaattactacaatagagataattggacagagcttccagctatgggatatgaagcggatgaaggtactaaaagtcaagtgttttcaatttcaggagatgatggtgtaaagctatggaacatgattaatcctgataaaaaaactgaagtcaaaagaaataataaagaagattttaaagataaattggagcaatactatccaattgatatggaaagttttaattccaacaaaccgaatgtaggtgacgaaaaagagattgactttaagtttgcacctgacacagacaaagaactctataaagaagatatcatcgttccagcaggatctacatcttgggggccaagaatagatttacttttaaaacccgatgtttcagcacctggtaaaaatattaaatccacgcttaatgttattaatggcaaatcaacttatggctatatgtcaggaactagtatggcgactccaatcgtggcagcttctactgttttgattagaccgaaattaaaggaaatgcttgaaagacctgtattgaaaaatcttaagggagatgacaaaatagatcttacaagtcttacaaaaattgccctacaaaatactgcgcgacctatgatggatgcaacttcttggaaagaaaaaagtcaatactttgcatcacctagacaacagggagcaggcctaattaatgtggccaatgctttgagaaatgaagttgtagcaactttcaaaaacactgattctaaaggtttggtaaactcatatggttccatttctcttaaagaaataaaaggtgataaaaaatactttacaatcaagcttcacaatacatcaaacagacctttgacttttaaagtttcagcatcagcgataactacagattctctaactgacagattaaaacttgatgaaacatataaagatgaaaaatctccagatggtaagcaaattgttccagaaattcacccagaaaaagtcaaaggagcaaatatcacatttgagcatgatactttcactataggcgcaaattctagctttgatttgaatgcggttataaatgttggagaggccaaaaacaaaaataaatttgtagaatcatttattcattttgagtcagtggaagcgatggaagctctaaactccagcgggaagaaaataaacttccaaccttctttgtcgatgcctctaatgggatttgctgggaattggaaccacgaaccaatccttgataaatgggcttgggaagaagggtcaagatcaaaaacactgggaggttatgatgatgatggtaaaccgaaaattccaggaaccttaaataagggaattggtggagaacatggtatagataaatttaatccagcaggagttatacaaaatagaaaagataaaaatacaacatccctggatcaaaatccagaattatttgctttcaataacgaagggatcaacgctccatcatcaagtggttctaagattgctaacatttatcctttagattcaaatggaaatcctcaagatgctcaacttgaaagaggattaacaccttctccacttgtattaagaagtgcagaagaaggattgatt

SEQ ID NO: 216 - protein, 1007 aa
ETSQDFKEKKTAVIKEKEVVSKNPVIDNNTSNEEAKIKEENSNKSQGDYTDSFVNKNTENPKKEDKVVYIAEFKDKESGEKAIKELSSLKNTKVLYTYDRIFNGSAIETTPDNLDKIKQIEGISSVERAQKVQPMMNHARKEIGVEEAIDYLKSINAPFGKNFDGRGMVISNIDTGTDYRHKAMRIDDDAKASMRFKKEDLKGTDKNYWLSDKIPHAFNYYNGGKITVEKYDDGRDYFDPHGMHIAGILAGNDTEQDIKNFNGIDGIAPNAQIFSYKMYSDAGSGFAGDETMFHAIEDSIKHNVDVVSVSSGFTGTGLVGEKYWQAIRALRKAGIPMVVATGNYATSASSSSWDLVANNHLKMTDTGNVTRTAAHEDAIAVASAKNQTVEFDKVNIGGESFKYRNIGAFFDKSKITTNEDGTKAPSKLKFVYIGKGQDQDLIGLDLRGKIAVMDRIYTKDLKNAFKKAMDKGARAIMVVNTVNYYNRDNWTELPAMGYEADEGTKSQVFSISGDDGVKLWNMINPDKKTEVKRNNKEDFKDKLEQYYPIDMESFNSNKPNVGDEKEIDFKFAPDTDKELYKEDIIVPAGSTSWGPRIDLLLKPDVSAPGKNIKSTLNVINGKSTYGYMSGTSMATPIVAASTVLIRPKLKEMLERPVLKNLKGDDKIDLTSLTKIALQNTARPMMDATSWKEKSQYFASPRQQGAGLINVANALRNEVVATFKNTDSKGLVNSYGSISLKEIKGDKKYFTIKLHNTSNRPLTFKVSASAITTDSLTDRLKLDETYKDEKSPDGKQIVPEIHPEKVKGANITFEHDTFTIGANSSFDLNAVINVGEAKNKNKFVESFIHFESVEAMEALNSSGKKINFQPSLSMPLMGFAGNWNHEPILDKWAWEEGSRSKTLGGYDDDGKPKIPGTLNKGIGGEHGIDKFNPAGVIQNRKDKNTTSLDQNPELFAFNNEGINAPSSSGSKIANIYPLDSNGNPQDAQLERGLTPSPLVLRSAEEGLI

SEQ ID NO: 217 - DNA, 1696 bp; double-stranded, linear
tgtggtcgaagttgagactcctcaatcaataacaaatcaggagcaagctaggacagaaaaccaagtagtagagacagaggaagctccaaaagaagaagcacctaaaacagaagaaagtccaaaggaagaaccaaaatcggaggtaaaacctactgacgacacccttcctaaagtagaagaggggaaagaagattcagcagaaccagctccagttgaagaagtaggtggagaagttgagtcaaaaccagaggaaaaagtagcagttaagccagaaagtcaaccatcagacaaaccagctgaggaatcaaaagttgaacaagcaggtgaaccagtcgcgccaagagaagacgaaaaggcaccagtcgagccagaaaagcaaccagaagctcctgaagaagagaaggctgtagaggaaacaccgaaacaagaagagtcaactccagataccaaggctgaagaaactgtagaaccaaaagaggagactgttaatcaatctattgaacaaccaaaagttgaaacgcctgctgtagaaaaacaaacagaaccaacagaggaaccaaaagttgaacaagcaggtgaaccagtcgcgccaagagaagacgaacaggcaccaacggcaccagttgagccagaaaagcaaccagaagttcctgaagaagagaaggctgtagaggaaacaccgaaaccagaagataaaataaagggtattggtactaaagaaccagttgataaaagtgagttaaataatcaaattgataaagctagttcagtttctcctactgattattctacagcaagttacaatgctcttggacctgttttagaaactgcaaaaggtgtctatgcttcagagcctgtaaaacagcctgaggtaaatagcgagacaaataaacttaaaacggctattgacgctctaaacgttgataaaactgaattaaacaatacgattgcagatgcaaaaacaaaggtaaaagaacattacagtgatagaagttggcaaaacctccaaactgaagttacaaaggctgaaaaagttgcagctaatacagatgctaaacaaagtgaagttaacgaagctgttgaaaaattaactgcaactattgaaaaattggttgaattatctgaaaagccaatattaacattgactagtaccgataagaaaatattggaacgtgaagctgttgctaagtatactctagaaaatcaaaacaaaacaaaaatcaaatcaatcacagctgaattgaaaaaaggagaagaagttattaatactgtagtccttacagatgacaaggtaacaacagaaactataagcgctgcatttaagaacctagagtactacaaagaatacaccctatctacaactatgatttacgacagaggtaacggtgaagaaactgaaactctagaaaatcaaaatattcaattagatcttaaaaaagttgagcttaaaaatattaaacgtacagatttaatcaaatacgaaaatggaaaagaaactaatgaatcactgataacaactattcctgatgataagagcaattattatttaaaaataacttcaaataatcagaaaactacattactagctgttaaaaatatagaagaaactacggttaacggaacacctgtatataaagttacagcaatcgcagacaatttagtctctagaactgctgataataaatttgaagaagaa

SEQ ID NO: 218 - protein, 565 aa
VVEVETPQSITNQEQARTENQVVETEEAPKEEAPKTEESPKEEPKSEVKPTDDTLPKVEEGKEDSAEPAPVEEVGGEVESKPEEKVAVKPESQPSDKPAEESKVEQAGEPVAPREDEKAPVEPEKQPEAPEEEKAVEETPKQEESTPDTKAEETVEPKEETVNQSIEQPKVETPAVEKQTEPTEEPKVEQAGEPVAPREDEQAPTAPVEPEKQPEVPEEEKAVEETPKPEDKIKGIGTKEPVDKSELNNQIDKASSVSPTDYSTASYNALGPVLETAKGVYASEPVKQPEVNSETNKLKTAIDALNVDKTELNNTIADAKTKVKEHYSDRSWQNLQTEVTKAEKVAANTDAKQSEVNEAVEKLTATIEKLVELSEKPILTLTSTDKKILEREAVAKYTLENQNKTKIKSITAELKKGEEVINTVVLTDDKVTTETISAAFKNLEYYKEYTLSTTMIYDRGNGEETETLENQNIQLDLKKVELKNIKRTDLIKYENGKETNESLITTIPDDKSNYYLKITSNNQKTTLLAVKNIEETTVNGTPVYKVTAIADNLVSRTADNKFEEE

SEQ ID NO: 219 - DNA, 1879 bp; double-stranded, linear
aacacctgtatataaagttacagcaatcgcagacaatttagtctctagaactgctgataataaatttgaagaagaatacgttcactatattgaaaaacctaaagtccacgaagataatgtatattataatttcaaagaattagtggaagctattcaaaacgatccttcaaaagaatatcgtctgggacaatcaatgagcgctagaaatgttgttcctaatggaaaatcatatatcactaaagaattcacaggaaaacttttaagttctgaaggaaaacaatttgctattactgaattggaacatccattatttaatgtgataacaaacgcaacgataaataatgtgaattttgaaaatgtagagatagaacgttctggtcaagataatattgcatcattagccaatactatgaaaggttcttcagttattacaaatgtcaaaattacaggcacactttcaggtcgtaataatgttgctggatttgtaaataatatgaatgatggaactcgtattgaaaatgttgctttctttggcaaactacactctacaagtggaaatggctctcatacagggggaattgcaggtacaaactatagaggaattgttagaaaagcatatgttgatgctactattacaggaaacaaaacacgcgccagcttgttagttcctaaagtagattatggattaactctagaccatcttattggtacaaaagctctcctaactgagtcggttgtaaaaggtaaaatagatgtttcaaatccagtagaagttggagcaatagcaagtaagacttggcctgtaggtacggtaagtaattctgtcagctatgctaagattatccgtggagaggagttattcggctctaacgacgttgatgattctgattatgctagtgctcatataaaagatttatatgcggtagagggatattcgtcaggtaatagatcatttaggaaatctaaaacatttactaaattaactaaagaacaagctgatgctaaagttactactttcaatattactgctgataaattagaaagtgatctatctcctcttgcaaaacttaatgaagaaaaagcctattctagtattcaagattataacgctgaatataaccaagcctataaaaatcttgaaaaattaataccattctacaataaagattatattgtatatcaaggtaataaattaaataaagaacaccatctaaatactaaagaagttctttctgttaccgcgatgaacaacaatgagtttatcacaaacctagatgaagctaataaaattattgttcactatgcggacggtacaaaagattactttaacttgtcttctagcagtgaaggtttaagtaatgtaaaagaatatactataactgacttaggaattaaatatacacctaatatcgttcaaaaagataacactactcttgttaatgatataaaatctattttagaatcagtagagcttcagtctcaaacgatgtatcagcatctaaatcgattaggtgactatagagttaatgcaatcaaagatttatatttagaagaaagcttcacagatgttaaagaaaacttaacaaacctaatcacaaaattagttcaaaacgaagaacatcaactaaatgattctccagctgctcgtcaaatgattcgtgataaagtcgagaaaaacaaagcagctttattactaggtttaacttacctaaatcgttactatggagttaaatttggtgatgttaatattaaagaattaatgctattcaaaccagatttctatggtgaaaaagttagcgtattagacagattaattgaaatcggttctaaagagaacaacattaaaggttcacgtacattcgacgcattcggtcaagta

SEQ ID NO: 220 - protein, 626 aa
TPVYKVTAIADNLVSRTADNKFEEEYVHYIEKPKVHEDNVYYNFKELVEAIQNDPSKEYRLGQSMSARNVVPNGKSYITKEFTGKLLSSEGKQFAITELEHPLFNVITNATINNVNFENVEIERSGQDNIASLANTMKGSSVITNVKITGTLSGRNNVAGFVNNMNDGTRIENVAFFGKLHSTSGNGSHTGGIAGTNYRGIVRKAYVDATITGNKTRASLLVPKVDYGLTLDHLIGTKALLTESVVKGKIDVSNPVEVGAIASKTWPVGTVSNSVSYAKIIRGEELFGSNDVDDSDYASAHIKDLYAVEGYSSGNRSFRKSKTFTKLTKEQADAKVTTFNITADKLESDLSPLAKLNEEKAYSSIQDYNAEYNQAYKNLEKLIPFYNKDYIVYQGNKLNKEHHLNTKEVLSVTAMNNNEFITNLDEANKIIVHYADGTKDYFNLSSSSEGLSNVKEYTITDLGIKYTPNIVQKDNTTLVNDIKSILESVELQSQTMYQHLNRLGDYRVNAIKDLYLEESFTDVKENLTNLITKLVQNEEHQLNDSPAARQMIRDKVEKNKAALLLGLTYLNRYYGVKFGDVNIKELMLFKPDFYGEKVSVLDRLIEIGSKENNIKGSRTFDAFGQV

SEQ ID NO: 221 - DNA, 1777 bp; double-stranded, linear
attagacagattaattgaaatcggttctaaagagaacaacattaaaggttcacgtacattcgacgcattcggtcaagtattggctaaatatactaaatcaggtaatttagatgcatttttaaattataatagacaattgttcacaaatatagacaatatgaacgattggtttattgatgctacagaagaccatgtctacatcgcagaacgcgcttctgaggtcgaagaaattaaaaattctaaacatcgtgcattcgataatttaaaacgaagtcaccttagaaatactatactcccactactgaatattgataaagcacatctttatttaatttcaaattataatgcaattgcctttggtagtgcagagcgattaggtaaaaaatcattagaagatattaaagatatcgttaacaaagctgcagatggttatagaaactattatgatttctggtatcgtctagcgtctgataacgttaaacaacgactactaagagatgctgttattcctatttgggaaggttataacgctcctggtggatgggttgaaaaatatggccgctataataccgacaaagtatatactcctcttagagaattctttggtcctatggataagtattataattataatggaacaggagcttatgctgctatatatcctaactctgatgatattagaactgatgtaaaatatgttcatttagaaatggttggtgaatacggtatttcagtttacacacatgaaacaacacacgtcaacgaccgtgcgatttacttaggtggctttggacaccgtgaaggtactgatgctgaagcatatgctcagggtatgctacaaactcctgttactggtagtggatttgatgagtttggttctttaggtattaatatggtatttaaacgcaaaaatgatgggaatcagtggtatattacagatccaaaaactctaaaaacacgagaagatattaatagatatatgaagggttataatgacactttaactcttcttgatgaaattgaggctgaatctgtgatttctcaacaaaataaagatttaaatagtgcatggttcaaaaaaatagatagagaataccgtgataacaataaattaaatcaatgggataaaattcgaaatctaagtcaagaagagaaaaatgaattaaatattcaatctgttaatgatttagttgatcaacaattaatgactaatcgcaatccaggtaatggtatctataaacccgaagcaattagctataacgatcaatcaccttatgtaggtgttagaatgatgaccggtatctacggaggtaatactagtaaaggtgctcctggagctgtttcattcaaacataatgcttttagattatggggttactacggatacgaaaatgggttcttaggttatgcttcaaataaatataaacaacaatctaaaacagatggtgagtctgttctaagtgatgaatatattatcaagaaaatatctaacaatacatttaatactattgaagaatttaaaaaagcttacttcaaagaagttaaagataaagcaacgaaaggattaacaacattcgaagtaaatggttcttccgtttcatcatacgatgatttactgacattgtttaaagaagctgttaaaaaagatgccgaaactcttaaacaagaagcaaacggtaataaaacagtatctatgaataatacagttaaattaaaagaagctgtttataagaaacttcttcaacaaacaaatagctttaaaacttcaatctttaaa

SEQ ID NO: 222 - protein, 592 aa
LDRLIEIGSKENNIKGSRTFDAFGQVLAKYTKSGNLDAFLNYNRQLFTNIDNMNDWFIDATEDHVYIAERASEVEEIKNSKHRAFDNLKRSHLRNTILPLLNIDKAHLYLISNYNAIAFGSAERLGKKSLEDIKDIVNKAADGYRNYYDFWYRLASDNVKQRLLRDAVIPIWEGYNAPGGWVEKYGRYNTDKVYTPLREFFGPMDKYYNYNGTGAYAAIYPNSDDIRTDVKYVHLEMVGEYGISVYTHETTHVNDRAIYLGGFGHREGTDAEAYAQGMLQTPVTGSGFDEFGSLGINMVFKRKNDGNQWYITDPKTLKTREDINRYMKGYNDTLTLLDEIEAESVISQQNKDLNSAWFKKIDREYRDNNKLNQWDKIRNLSQEEKNELNIQSVNDLVDQQLMTNRNPGNGIYKPEAISYNDQSPYVGVRMMTGIYGGNTSKGAPGAVSFKHNAFRLWGYYGYENGFLGYASNKYKQQSKTDGESVLSDEYIIKKISNNTFNTIEEFKKAYFKEVKDKATKGLTTFEVNGSSVSSYDDLLTLFKEAVKKDAETLKQEANGNKTVSMNNTVKLKEAVYKKLLQQTNSFKTSIFK

SEQ ID NO: 223 - DNA, 460 bp; double-stranded, linear
taagacagatgaacggagcaaggtgtttgacttttccattccctactatactgcaaaaaataaactcattgtcaaaaaatctgacttgactacttatcagtctgtaaacgacttggcgcagaaaaaggttggagcgcagaaaggttcgattcaagagacgatggcgaaagatttgctacaaaattcttccctcgtatctctgcctaaaaatgggaatttaatcacagatttaaaatcaggacaagtggatgccgttatctttgaagaacctgtttccaagggatttgtggaaaataatcctgatttagcaatcgcagacctcaattttgaaaaagagcaagatgattcctacgcggtagccatgaaaaaagatagcaagaaattgaagaggcagttcgataaaaccattcaaaagttgaaggagtctggggaattagacaaactcattgaggaagcctta

SEQ ID NO: 224 - protein, 153 aa
KTDERSKVFDFSIPYYTAKNKLIVKKSDLTTYQSVNDLAQKKVGAQKGSIQETMAKDLLQNSSLVSLPKNGNLITDLKSGQVDAVIFEEPVSKGFVENNPDLAIADLNFEKEQDDSYAVAMKKDSKKLKRQFDKTIQKLKESGELDKLIEEAL

SEQ ID NO: 225 - DNA, 751 bp; double-stranded, linear
ctgtgagaatcaagctacacccaaagagactagcgctcaaaagacaatcgtccttgctacagctggcgacgtgccaccatttgactacgaagacaagggcaatctgacaggctttgatatcgaagttttaaaggcagtagatgaaaaactcagcgactacgagattcaattccaaagaaccgcctgggagagcatcttcccaggacttgattctggtcactatcaggctgcggccaataacttgagttacacaaaagagcgtgctgaaaaatacctttactcgcttccaatttccaacaatcccctcgtccttgtcagcaacaagaaaaatcctttgacttctcttgaccagatcgctggtaaaacaacacaagaggataccggaacttctaacgctcaattcatcaataactggaatcagaaacacactgataatcccgctacaattaatttttctggtgaggatattggtaaacgaatcctagaccttgctaacggagagtttgatttcctagtttttgacaaggtatccgttcaaaagattatcaaggaccgtggtttagacctctcagtcgttgatttaccttctgcagatagccccagcaattatatcattttctcaagcgaccaaaaagagtttaaagagcaatttgataaagcgctcaaagaactctatcaagacggaacccttgaaaaactcagcaatacctatctaggtggttcttacctcccagatcaatctcagttacaa

SEQ ID NO: 226 - protein, 250 aa
CENQATPKETSAQKTIVLATAGDVPPFDYEDKGNLTGFDIEVLKAVDEKLSDYEIQFQRTAWESIFPGLDSGHYQAAANNLSYTKERAEKYLYSLPISNNPLVLVSNKKNPLTSLDQIAGKTTQEDTGTSNAQFINNWNQKHTDNPATINFSGEDIGKRILDLANGEFDFLVFDKVSVQKIIKDRGLDLSVVDLPSADSPSNYIIFSSDQKEFKEQFDKALKELYQDGTLEKLSNTYLGGSYLPDQSQLQ

SEQ ID NO: 227 - DNA, 33 bp; double-stranded, linear
gactggatcctaaaatctacgacaataaaaatc

SEQ ID NO: 228 - DNA, 27 bp; double-stranded, linear
ctgagtcgactggttgtgctggttgag

SEQ ID NO: 229 - DNA, 30 bp; double-stranded, linear
gtcaggatccaaattacaatacggactatg

SEQ ID NO: 230 - DNA, 28 bp; double-stranded, linear
cagtgtcgactaactctaggtcggaaac

SEQ ID NO: 231 - DNA, 35 bp; double-stranded, linear
gactggatcctgagaatcaagctacacccaaagag

SEQ ID NO: 232 - DNA, 31 bp; double-stranded, linear
agtcaagcttttgtaactgagattgatctgg

SEQ ID NO: 233 - DNA, 37 bp; double-stranded, linear
gactggatcctggtaaccgctcttctcgtaacgcagc

SEQ ID NO: 234 - DNA, 32 bp; double-stranded, linear
agtcaagctttttcaggaacttttacgcttcc

SEQ ID NO: 235 - DNA, 45 bp; double-stranded, linear
agtcagatcttgtggaaatttgacaggtaacagcaaaaaagctgc

SEQ ID NO: 236 - DNA, 33 bp; double-stranded, linear
actgaagcttttttgtttttcaagaattcatcg

SEQ ID NO: 237 - DNA, 35 bp; double-stranded, linear
gactggatcctggtcaaggaactgcttctaaagac

SEQ ID NO: 238 - DNA, 32 bp; double-stranded, linear
agtcaagctttcacaaattcgttggtgaagcc

SEQ ID NO: 239 - DNA, 38 bp; double-stranded, linear
gactggatcctagctcaggtggaaacgctggttcatcc

SEQ ID NO: 240 - DNA, 35 bp; double-stranded, linear
agtcaagcttatcaacttttccaccttcaacaacc

SEQ ID NO: 241 - DNA, 37 bp; double-stranded, linear
gtcaagatctctccaactatggtaaatctgcggatgg

SEQ ID NO: 242 - DNA, 42 bp; double-stranded, linear
agtcctgcagatccacatccgctttcatcgggttaaagaagg

SEQ ID NO: 243 - DNA, 37 bp; double-stranded, linear
gactggatcctgggaaaaattctagcgaaactagtgg

SEQ ID NO: 244 - DNA, 37 bp; double-stranded, linear
gtcactgcagctgtccttcttttacttctttggttgc

SEQ ID NO: 245 - DNA, 40 bp; double-stranded, linear
gactggatcctgctagcggaaaaaaagatacaacttctgg

SEQ ID NO: 246 - DNA, 37 bp; double-stranded, linear
ctgaaagcttttttgccaatccttcagcaatcttgtc

SEQ ID NO: 247 - DNA, 37 bp; double-stranded, linear
gactagatcttggctcaaaaaatacagcttcaagtcc

SEQ ID NO: 248 - DNA, 35 bp; double-stranded, linear
agtcctgcaggtttttgtttgcttggtattggtcg

SEQ ID NO: 249 - DNA, 41 bp; double-stranded, linear
gactggatcctagtacaaactcaagcactagtcagacagag

SEQ ID NO: 250 - DNA, 34 bp; double-stranded, linear
cagtctgcagtttcaaagctttttgtatgtcttc

SEQ ID NO: 251 - DNA, 37 bp; double-stranded, linear
gactggatcctggcaattctggcggaagtaaagatgc

SEQ ID NO: 252 - DNA, 36 bp; double-stranded, linear
agtcaagcttgtttcatagcttttttgattgtttcg

SEQ ID NO: 253 - DNA, 40 bp; double-stranded, linear
gactggatccttcacaagaaaaaacaaaaaatgaagatgg

SEQ ID NO: 254 - DNA, 31 bp; double-stranded, linear
agtcaagcttatcgacgtagtctccgccttc

SEQ ID NO: 255 - DNA, 38 bp; double-stranded, linear
gactggatccgaaaggtctgtggtcaaataatcttacc

SEQ ID NO: 256 - DNA, 37 bp; double-stranded, linear
agtcaagcttagagttaacatggtgcttgccaatagg

SEQ ID NO: 257 - DNA, 37 bp; double-stranded, linear
gactggatccaaactcagaaaagaaagcagacaatgc

SEQ ID NO: 258 - DNA, 36 bp; double-stranded, linear
agtcaagcttccaaactggttgatccaaaccatctg

SEQ ID NO: 259 - DNA, 36 bp; double-stranded, linear
gactggatccttcgaaagggtcagaaggtgcagacc

SEQ ID NO: 260 - DNA, 36 bp; double-stranded, linear
agtcaagcttctgtaggcttggtgtgccccagttgc

SEQ ID NO: 261 - DNA, 33 bp; double-stranded, linear
ctgaggatccggggatggcagcttttaaaaatc

SEQ ID NO: 262 - DNA, 31 bp; double-stranded, linear
cagtaagcttgtttacccattcaccattacc

SEQ ID NO: 263 - DNA, 29 bp; double-stranded, linear
cagtggatccagacgagcaaaaaattaag

SEQ ID NO: 264 - DNA, 28 bp; double-stranded, linear
tcagaagcttgtttacccattcaccatt

SEQ ID NO: 265 - DNA, 35 bp; double-stranded, linear
gactggatccctgtggtgaggaagaaactaaaaag

SEQ ID NO: 266 - DNA, 38 bp; double-stranded, linear
ctgagtcgacaatattctgtaggaatgcttcgaatttg

SEQ ID NO: 267 - DNA, 38 bp; double-stranded, linear
ctgaggatccgacttttaacaataaaactattgaagag

SEQ ID NO: 268 - DNA, 33 bp; double-stranded, linear
gtcactgcaggttgtcacctccaaaaatcacgg

SEQ ID NO: 269 - DNA, 37 bp; double-stranded, linear
gactggatccctttacaggtaaacaactacaagtcgg

SEQ ID NO: 270 - DNA, 32 bp; double-stranded, linear
cagtaagcttttcgaagtttggctcagaattg

SEQ ID NO: 271 - DNA, 32 bp; double-stranded, linear
gactggatccccaggctgatacaagtatcgca

SEQ ID NO: 272 - DNA, 31 bp; double-stranded, linear
cagtaagcttatctgcagtatggctagatgg

SEQ ID NO: 273 - DNA, 37 bp; double-stranded, linear
gactggatccgtctgtatcatttgaaaacaaagaaac

SEQ ID NO: 274 - DNA, 32 bp; double-stranded, linear
cagtctgcagttttactgttgctgtgcttgtg

SEQ ID NO: 275 - DNA, 39 bp; double-stranded, linear
actgagatcttggtcaaaaggaaagtcagacaggaaagg

SEQ ID NO: 276 - DNA, 41 bp; double-stranded, linear
cagtaagcttattcctgagcttttttgataaaggttgcgca

SEQ ID NO: 277 - DNA, 40 bp; double-stranded, linear
actgggatccgaaggatagatatattttagcatttgagac

SEQ ID NO: 278 - DNA, 35 bp; double-stranded, linear
agtcaagcttccatggtatcaaaggcaagacttgg

SEQ ID NO: 279 - DNA, 34 bp; double-stranded, linear
gtcaggatccggtagttaaagttggtattaacgg

SEQ ID NO: 280 - DNA, 36 bp; double-stranded, linear
agtcaagcttgcaatttttgcgaagtattccaagag

SEQ ID NO: 281 - DNA, 37 bp; double-stranded, linear
agtcggatccttcttacgagttgggactgtatcaagc

SEQ ID NO: 282 - DNA, 40 bp; double-stranded, linear
agtcaagcttgtttattttttccttacttacagatgaagg

SEQ ID NO: 283 - DNA, 37 bp; double-stranded, linear
agtcggatcctactgagatgcatcataatctaggagc

SEQ ID NO: 284 - DNA, 37 bp; double-stranded, linear
tcagctcgagttctttgacatctccatcataagtcgc

SEQ ID NO: 285 - DNA, 35 bp; double-stranded, linear
gactggatccggttttgagaaagtatttgcagggg

SEQ ID NO: 286 - DNA, 39 bp; double-stranded, linear
cagtaagcttggattttttcatggatgcaatttttttgg

SEQ ID NO: 287 - DNA, 43 bp; double-stranded, linear
gactggatccgacaacatttactatccatacagtagagtcagc

SEQ ID NO: 288 - DNA, 40 bp; double-stranded, linear
gactaagcttggcataaggttgcaattctggattaattgg

SEQ ID NO: 289 - DNA, 30 bp; double-stranded, linear
gactggatccggctaaggaaagagtggatg

SEQ ID NO: 290 - DNA, 37 bp; double-stranded, linear
gactaagcttttcatttttaaattgactatgcgcccg

SEQ ID NO: 291 - DNA, 36 bp; double-stranded, linear
gactggatccttgttcctatgaacttggtcgtcacc

SEQ ID NO: 292 - DNA, 35 bp; double-stranded, linear
catgaagcttatcctggatttttccaagtaaatct

SEQ ID NO: 293 - DNA, 34 bp; double-stranded, linear
gactggatccttataagggtgaattagaaaaagg

SEQ ID NO: 294 - DNA, 33 bp; double-stranded, linear
gactaagcttcttattaggattgttagtagttg

SEQ ID NO: 295 - DNA, 37 bp; double-stranded, linear
gactggatccgaatgttcaggctcaagaaagttcagg

SEQ ID NO: 296 - DNA, 36 bp; double-stranded, linear
gactaagcttttcccctgatggagcaaagtaatacc

SEQ ID NO: 297 - DNA, 40 bp; double-stranded, linear
gactggatcccttgggtgtaacccatatccagctccttcc

SEQ ID NO: 298 - DNA, 34 bp; double-stranded, linear
gactgtcgacttcagcttgtttatctggggttgc

SEQ ID NO: 299 - DNA, 38 bp; double-stranded, linear
gactggatcctagtgatggtacttggcaaggaaaacag

SEQ ID NO: 300 - DNA, 35 bp; double-stranded, linear
actgctgcagatctttgccacctagcttctcattg

SEQ ID NO: 301 - DNA, 40 bp; double-stranded, linear
gtcaggatcctgggattcaatatgtcagagatgatactag

SEQ ID NO: 302 - DNA, 35 bp; double-stranded, linear
ctagaagcttacgcacccattcaccattatcattg

SEQ ID NO: 303 - DNA, 35 bp; double-stranded, linear
gtcaggatccggataatagagaagcattaaaaacc

SEQ ID NO: 304 - DNA, 36 bp; double-stranded, linear
agtcaagcttgacaaaatcttgaaactcctctggtc

SEQ ID NO: 305 - DNA, 35 bp; double-stranded, linear
gtcaggatccagattttgtcgaggagtgtcatacc

SEQ ID NO: 306 - DNA, 36 bp; double-stranded, linear
agtcaagctttccctttttacccttacgaatccagg

SEQ ID NO: 307 - DNA, 43 bp; double-stranded, linear
gactggatccatctgtagtttatgcggatgaaacacttattac

SEQ ID NO: 308 - DNA, 34 bp; double-stranded, linear
gactgtcgacgctttggtagagatagaagtcatg

SEQ ID NO: 309 - DNA, 38 bp; double-stranded, linear
gactggatccttactttggtatcgtagatacagccggc

SEQ ID NO: 310 - DNA, 37 bp; double-stranded, linear
agtcaagctttgttaattgcgtaccttctaagcgacc

SEQ ID NO: 311 - DNA, 37 bp; double-stranded, linear
gactggatccagctaaggttgcatgggatgcgattcg

SEQ ID NO: 312 - DNA, 34 bp; double-stranded, linear
gactgtcgacctgggctttattagtttgactagc

SEQ ID NO: 313 - DNA, 33 bp; double-stranded, linear
cagtggatccctatcactatgtaaataaagaga

SEQ ID NO: 314 - DNA, 30 bp; double-stranded, linear
actgaagcttttctgtccctgtttgaggca

SEQ ID NO: 315 - DNA, 34 bp; double-stranded, linear
cagtggatcctgagactcctcaatcaataacaaa

SEQ ID NO: 316 - DNA, 34 bp; double-stranded, linear
acgtaagcttataatcagtaggagaaactgaact

SEQ ID NO: 317 - DNA, 30 bp; double-stranded, linear
cagtggatccggatgctcaagaaactgcgg

SEQ ID NO: 318 - DNA, 31 bp; double-stranded, linear
gactaagcttttgcctctcattcttgcttcc

SEQ ID NO: 319 - DNA, 29 bp; double-stranded, linear
cagtggatcccgacaaaggtgagactgag

SEQ ID NO: 320 - DNA, 36 bp; double-stranded, linear
acgtaagcttatttcttaattcaagtgttttctctg

SEQ ID NO: 321 - DNA, 34 bp; double-stranded, linear
gactggatccaaatcaattggtagcacaagatcc

SEQ ID NO: 322 - DNA, 29 bp; double-stranded, linear
cagtgtcgacattaggagccactggtctc

SEQ ID NO: 323 - DNA, 31 bp; double-stranded, linear
cagtggatcccaaacagtcagcttcaggaac

SEQ ID NO: 324 - DNA, 30 bp; double-stranded, linear
gactctgcagtttaatcttgtcccaggtgg

SEQ ID NO: 325 - DNA, 32 bp; double-stranded, linear
gactggatccattcgatgatgcggatgaaaag

SEQ ID NO: 326 - DNA, 33 bp; double-stranded, linear
gactaagcttcatttgtctttgggtatttcgca

SEQ ID NO: 327 - DNA, 30 bp; double-stranded, linear
cagtggatccggagagtcgatcaaaagtag

SEQ ID NO: 328 - DNA, 28 bp; double-stranded, linear
gtcactgcagttgctcgtctcgaggttc

SEQ ID NO: 329 - DNA, 32 bp; double-stranded, linear
cagtggatccatggacaacaggaaactgggac

SEQ ID NO: 330 - DNA, 33 bp; double-stranded, linear
cagtaagcttattagcttctgtacctgtgtttg

SEQ ID NO: 331 - DNA, 41 bp; double-stranded, linear
gactggatcccgatgggctcaatccaaccccaggtcaagtc

SEQ ID NO: 332 - DNA, 40 bp; double-stranded, linear
gactctgcagcatagctttatcctctgacatcatcgtatc

SEQ ID NO: 333 - DNA, 34 bp; double-stranded, linear
gactggatccttccaatcaaaaacaggcagatgg

SEQ ID NO: 334 - DNA, 30 bp; double-stranded, linear
gactaagcttgagtcccatagtccaaggca

SEQ ID NO: 335 - DNA, 38 bp; double-stranded, linear
agtcggatcctatcacaggatcgaacggtaagacaacc

SEQ ID NO: 336 - DNA, 34 bp; double-stranded, linear
actggtcgacttcttttaactccgctactgtgtc

SEQ ID NO: 337 - DNA, 38 bp; double-stranded, linear
cagtggatccaagttcatcgaagatggttgggaagtcc

SEQ ID NO: 338 - DNA, 32 bp; double-stranded, linear
gatcgtcgacccgctcccacatgctcaacctt

SEQ ID NO: 339 - DNA, 37 bp; double-stranded, linear
tgacggatccatcgctagctagtgaaatgcaagaaag

SEQ ID NO: 340 - DNA, 37 bp; double-stranded, linear
tgacaagcttattcgtttttgaactagttgctttcgt

SEQ ID NO: 341 - DNA, 37 bp; double-stranded, linear
gactggatccgcaccagatggggcacaaggttcaggg

SEQ ID NO: 342 - DNA, 35 bp; double-stranded, linear
tgacaagcttaacttgtaacgaacagttcaatctg

SEQ ID NO: 343 - DNA, 36 bp; double-stranded, linear
gactagatctttttaacccaactgttggtactttcc

SEQ ID NO: 344 - DNA, 34 bp; double-stranded, linear
tgacaagcttgttaggtgttacattttgaccgtc

SEQ ID NO: 345 - DNA, 35 bp; double-stranded, linear
actgagatctttttaacccaactgttggtactttc

SEQ ID NO: 346 - DNA, 37 bp; double-stranded, linear
gactaagctttctacgataacgatcattttctttacc

SEQ ID NO: 347 - DNA, 38 bp; double-stranded, linear
gactgtcgactcgtagatatttaagtctaagtgaagcg

SEQ ID NO: 348 - DNA, 34 bp; double-stranded, linear
agtcaagcttgttaggtgttacattttgcaagtc

SEQ ID NO: 349 - DNA, 32 bp; double-stranded, linear
gactggatccctttggttttgaaggaagtaag

SEQ ID NO: 350 - DNA, 37 bp; double-stranded, linear
tgacctgcagacgatttttgaaaaatggaggtgtatc

SEQ ID NO: 351 - DNA, 31 bp; double-stranded, linear
cagtggatccctactacctctcgagagaaag

SEQ ID NO: 352 - DNA, 32 bp; double-stranded, linear
actgaagcttttcgctttttactcgtttgaca

SEQ ID NO: 353 - DNA, 42 bp; double-stranded, linear
cagtggatcctaaggtcaaaagtcagaccgctaagaaagtgc

SEQ ID NO: 354 - DNA, 38 bp; double-stranded, linear
cagtaagctttagggtatccaaatactggttgttgatg

SEQ ID NO: 355 - DNA, 36 bp; double-stranded, linear
tgacagatcttgacgggtctcaggatcagactcagg

SEQ ID NO: 356 - DNA, 36 bp; double-stranded, linear
tgacaagcttcaaagacatccacctcttgacctttg

SEQ ID NO: 357 - DNA, 38 bp; double-stranded, linear
gactggatcctagaggctttgccaaatggtgggaaggg

SEQ ID NO: 358 - DNA, 40 bp; double-stranded, linear
gtcagtcgacttgttgtaacacttttcgaggtttggtacc

SEQ ID NO: 359 - DNA, 33 bp; double-stranded, linear
cagtggatcctcaaaaagagaaggaaaacttgg

SEQ ID NO: 360 - DNA, 34 bp; double-stranded, linear
cagtctgcagtttcttcaacaaaccttgttcttg

SEQ ID NO: 361 - DNA, 31 bp; double-stranded, linear
cagtggatccacgttctattgaggaccactt

SEQ ID NO: 362 - DNA, 34 bp; double-stranded, linear
cagtaagcttttccttctcagtcaattcttttcc

SEQ ID NO: 363 - DNA, 35 bp; double-stranded, linear
gactggatcccgctcaaaataccagaggtgttcag

SEQ ID NO: 364 - DNA, 36 bp; double-stranded, linear
gactaagcttagtaccatgggtgtgacaggtttgaa

SEQ ID NO: 365 - DNA, 35 bp; double-stranded, linear
ctgaggatccaattgtacaattagaaaaagatagc

SEQ ID NO: 366 - DNA, 34 bp; double-stranded, linear
tgacaagcttgcgttgactaggttctgcaatgcc

SEQ ID NO: 367 - DNA, 40 bp; double-stranded, linear
gactggatcctctgaccaagcaaaaagaagcagtcaatga

SEQ ID NO: 368 - DNA, 34 bp; double-stranded, linear
tcagcagctgatcattgactttacgatttgctcc

SEQ ID NO: 369 - DNA, 41 bp; double-stranded, linear
gactggatccgtccggctctgtccagtccactttttcagcg

SEQ ID NO: 370 - DNA, 33 bp; double-stranded, linear
tcagaagcttattttttgtttccttaatgcgtt

SEQ ID NO: 371 - DNA, 39 bp; double-stranded, linear
gactggatccgggacaaattcaaaaaaataggcaagagg

SEQ ID NO: 372 - DNA, 34 bp; double-stranded, linear
gtcaaagctttggctctttgattgccaacaactg

SEQ ID NO: 373 - DNA, 39 bp; double-stranded, linear
gactggatcctcgctaccagcaacaaagcgagcaaaagg

SEQ ID NO: 374 - DNA, 32 bp; double-stranded, linear
gactaagcttacttttttctttttccacacga

SEQ ID NO: 375 - DNA, 39 bp; double-stranded, linear
cagtggatccgaaccgacaagtcgcccactatcaagact

SEQ ID NO: 376 - DNA, 33 bp; double-stranded, linear
ctgaaagctttgaattctctttcttttcaggct

SEQ ID NO: 377 - DNA, 36 bp; double-stranded, linear
tcgaggatccggttgtcggctggcaatatatcccgt

SEQ ID NO: 378 - DNA, 37 bp; double-stranded, linear
cagtaagcttccgaacccattcgccattatagttgac

SEQ ID NO: 379 - DNA, 35 bp; double-stranded, linear
agtcggatccggccaaatcagaatgggtagaagac

SEQ ID NO: 380 - DNA, 34 bp; double-stranded, linear
tgacctgcagcttctcattgattttcatcatcac

SEQ ID NO: 381 - DNA, 35 bp; double-stranded, linear
gactggatccatttgcagatgattctgaaggatgg

SEQ ID NO: 382 - DNA, 38 bp; double-stranded, linear
tcagctgcagcttaacccattcaccattctagtttaag

SEQ ID NO: 383 - DNA, 37 bp; double-stranded, linear
gactggatcctgtcgctgcaaatgaaactgaagtagc

SEQ ID NO: 384 - DNA, 34 bp; double-stranded, linear
gactaagcttataccaaacgctgacatctacgcg

SEQ ID NO: 385 - DNA, 37 bp; double-stranded, linear
agtcagatcttacgtctcagcctacttttgtaagagc

SEQ ID NO: 386 - DNA, 34 bp; double-stranded, linear
gactaagcttaacccattcaccattggcattgac

SEQ ID NO: 387 - DNA, 41 bp; double-stranded, linear
cagtggatcctggacaggtgaaaggtcatgctacatttgtg

SEQ ID NO: 388 - DNA, 33 bp; double-stranded, linear
gactaagcttcaaccattgagaccttgcaacac

SEQ ID NO: 389 - DNA, 41 bp; double-stranded, linear
gtcaggatccgattgctcctttgaaggatttgagagaaacc

SEQ ID NO: 390 - DNA, 41 bp; double-stranded, linear
gactaagcttcgatcaaagataagataaatatatataaagt

SEQ ID NO: 391 - DNA, 47 bp; double-stranded, linear
gactggatcctaggtcatatgggactttttttctacaacaaaatagg

SEQ ID NO: 392 - DNA, 37 bp; double-stranded, linear
tgacaagcttatctatcagctcatttaatcgtttttg

SEQ ID NO: 393 - DNA, 35 bp; double-stranded, linear
ctgaggatcccaacgttgagaattatttgcgaatg

SEQ ID NO: 394 - DNA, 31 bp; double-stranded, linear
tgacaagcttgagtctacaaaagtaatgtac

SEQ ID NO: 395 - DNA, 35 bp; double-stranded, linear
gtcaggatccctactatcaatcaagttcttcagcc

SEQ ID NO: 396 - DNA, 37 bp; double-stranded, linear
tgacaagcttgactgaggcttggaccagattgaaaag

SEQ ID NO: 397 - DNA, 36 bp; double-stranded, linear
gactggatccgacaaaaacattaaaacgtcctgagg

SEQ ID NO: 398 - DNA, 34 bp; double-stranded, linear
gactaagcttagcacgaactgtgacgctggttcc

SEQ ID NO: 399 - DNA, 35 bp; double-stranded, linear
gactggatccttctcaggagacctttaaaaatatc

SEQ ID NO: 400 - DNA, 31 bp; double-stranded, linear
gactaagcttgttggccatcttgtacatacc

SEQ ID NO: 401 - DNA, 31 bp; double-stranded, linear
gactggatccagtaaatgcgcaatcaaattc

SEQ ID NO: 402 - DNA, 37 bp; double-stranded, linear
agtcctgcaggtatttagcccaataatctataaagct

SEQ ID NO: 403 - DNA, 32 bp; double-stranded, linear
cagtggatccttaccgcgttcatcaagatgtc

SEQ ID NO: 404 - DNA, 32 bp; double-stranded, linear
gactaagcttgccagatgttgaaaagagagtg

SEQ ID NO: 405 - DNA, 40 bp; double-stranded, linear
gactggatccgtggatgggctttaactatcttcgtattcg

SEQ ID NO: 406 - DNA, 33 bp; double-stranded, linear
agtcaagcttgctagtcttcactttccctttcc

SEQ ID NO: 407 - DNA, 34 bp; double-stranded, linear
gactgtcgacactaaaccagcatcgttcgcagga

SEQ ID NO: 408 - DNA, 35 bp; double-stranded, linear
ctgactgcagcttcttgaagaaataatgattgtgg

SEQ ID NO: 409 - DNA, 32 bp; double-stranded, linear
cagtggatcctgactaccttgaaatcccactt

SEQ ID NO: 410 - DNA, 39 bp; double-stranded, linear
cagtaagcttttttttaaggttgtagaatgatttcaatc

SEQ ID NO: 411 - DNA, 35 bp; double-stranded, linear
cagtgtcgactcgtatctttttttggagcaatgtt

SEQ ID NO: 412 - DNA, 33 bp; double-stranded, linear
gactaagcttaaatgttccgatacgggtgattg

SEQ ID NO: 413 - DNA, 33 bp; double-stranded, linear
cagtggatccggactctctcaaagatgtgaaag

SEQ ID NO: 414 - DNA, 34 bp; double-stranded, linear
gactaagcttcttgagtttgtcaaggattgcttt

SEQ ID NO: 415 - DNA, 38 bp; double-stranded, linear
cagtggatcccaagaaatcctatcatctcttccagaag

SEQ ID NO: 416 - DNA, 33 bp; double-stranded, linear
gactaagcttttcagaactaaaagccgcagctt

SEQ ID NO: 417 - DNA, 30 bp; double-stranded, linear
gactggatccacgaaatgcagggcagacag

SEQ ID NO: 418 - DNA, 36 bp; double-stranded, linear
cagtaagcttatcaacataatctagtaaataagcgt

SEQ ID NO: 419 - DNA, 36 bp; double-stranded, linear
cagtggatcctgtatagtttttagcgcttgttcttc

SEQ ID NO: 420 - DNA, 36 bp; double-stranded, linear
gtcaaagctttgatagagtgtcataatcttctttag

SEQ ID NO: 421 - DNA, 32 bp; double-stranded, linear
gactggatccgtgtgtcgagcatattctgaag

SEQ ID NO: 422 - DNA, 37 bp; double-stranded, linear
cagtaagcttacttttaccatttctttgttctgcatc

SEQ ID NO: 423 - DNA, 38 bp; double-stranded, linear
gactgtcgacgtgtttggatagcattcagaatcagacg

SEQ ID NO: 424 - DNA, 32 bp; double-stranded, linear
cagtaagcttcggaagtaaagacaatttttcc

SEQ ID NO: 425 - DNA, 37 bp; double-stranded, linear
cagtggatccgtgcctagatagtattattactcaaac

SEQ ID NO: 426 - DNA, 34 bp; double-stranded, linear
gactaagctttttgcttatttctctcaatttttc

SEQ ID NO: 427 - DNA, 36 bp; double-stranded, linear
cagtggatcccattcagaagcagacctatcaaaatc

SEQ ID NO: 428 - DNA, 43 bp; double-stranded, linear
actgaagcttatgtaattttttagatttttcaatatttttcag

SEQ ID NO: 429 - DNA, 35 bp; double-stranded, linear
agtcggatcctaaggctgataatcgtgttcaaatg

SEQ ID NO: 430 - DNA, 31 bp; double-stranded, linear
gactaagcttaaaattagatagacgttgagt

SEQ ID NO: 431 - DNA, 35 bp; double-stranded, linear
agtcggatccctgtggcaatcagtcagctgcttcc

SEQ ID NO: 432 - DNA, 40 bp; double-stranded, linear
gactgtcgactttaatcttgtcccaggtggttaatttgcc

SEQ ID NO: 433 - DNA, 38 bp; double-stranded, linear
actggtcgacttgtcaacaacaacatgctacttctgag

SEQ ID NO: 434 - DNA, 35 bp; double-stranded, linear
gactctgcagaagtttaacccacttatcattatcc

SEQ ID NO: 435 - DNA, 39 bp; double-stranded, linear
actgggatccttgttcaggcaagtccgtgactagtgaac

SEQ ID NO: 436 - DNA, 33 bp; double-stranded, linear
gactaagcttggctaattccttcaaagtttgca

SEQ ID NO: 437 - DNA, 39 bp; double-stranded, linear
agtcggatccctcgcaaattgaaaaggcggcagttagcc

SEQ ID NO: 438 - DNA, 35 bp; double-stranded, linear
gactaagcttgtaaataagcgtacctttttcttcc

SEQ ID NO: 439 - DNA, 38 bp; double-stranded, linear
tcagggatccttgtcagtcaggttctaatggttctcag

SEQ ID NO: 440 - DNA, 32 bp; double-stranded, linear
agtcaagcttggcattggcgtcgccgtccttc

SEQ ID NO: 441 - DNA, 38 bp; double-stranded, linear
gactggatccggaaacttcacaggattttaaagagaag

SEQ ID NO: 442 - DNA, 34 bp; double-stranded, linear
gactgtcgacaatcaatccttcttctgcacttct

SEQ ID NO: 443 - DNA, 37 bp; double-stranded, linear
cagtggatcctgtggtcgaagttgagactcctcaatc

SEQ ID NO: 444 - DNA, 31 bp; double-stranded, linear
gactaagcttttcttcaaatttattatcagc

SEQ ID NO: 445 - DNA, 39 bp; double-stranded, linear
agtcggatccaacacctgtatataaagttacagcaatcg

SEQ ID NO: 446 - DNA, 37 bp; double-stranded, linear
gactgtcgactacttgaccgaatgcgtcgaatgtacg

SEQ ID NO: 447 - DNA, 34 bp; double-stranded, linear
ctgaggatccattagacagattaattgaaatcgg

SEQ ID NO: 448 - DNA, 34 bp; double-stranded, linear
gactgtcgactttaaagattgaagttttaaagct

SEQ ID NO: 449 - DNA, 35 bp; double-stranded, linear
tgacggatcctaagacagatgaacggagcaaggtg

SEQ ID NO: 450 - DNA, 35 bp; double-stranded, linear
ctgaaagctttaaggcttcctcaatgagtttgtct

SEQ ID NO: 451 - DNA, 33 bp; double-stranded, linear
gactggatccctgtgagaatcaagctacaccca

SEQ ID NO: 452 - DNA, 34 bp; double-stranded, linear
ctgaaagcttttgtaactgagattgatctgggag

What is claimed is:

1. An isolated polynucleotide consisting of a nucleic acid sequence encoding an amino acid sequence consisting of SEQ ID NO:56.

2. An isolated polynucleotide consisting of the full complement of the nucleic acid sequence of claim 1.

3. The isolated polynucleotide of claim 1 which is fused to a heterologous polynucleotide sequence.

4. The isolated polynucleotide of claim 3, wherein said heterologous polynucleotide sequence encodes a polypeptide.

5. A method of making a recombinant vector comprising insetting the isolated polynucleotide of claim 1 into a vector.

6. A recombinant vector comprising the isolated polynucleotide of claim 1.

7. The recombinant vector of claim 6, wherein said polynucleotide operably associated with a heterologous regulatory sequence that controls gene expression.

8. A recombinant host cell comprising the isolated polynucleotide of claim 1.

9. The recombinant host cell of claim 8, wherein said polynucleotide is operably associated with a heterologous regulatory sequence that controls gene expression.

10. A method for producing a polypeptide, comprising:
   (a) culturing a recombinant host cell comprising the isolated polynucleotide of claim 1 under conditions suitable to produce a polypeptide encoded by said polynucleotide: and
   (b) recovering the polypeptide.

11. An isolated polynucleotide consisting of a nucleic acid sequence encoding an amino acid sequence consisting of a portion of the amino acid sequence of SEQ ID NO:56, wherein said portion is selected from the group consisting of
   (a) Arg-10 to Arg-17;
   (b) Lys-29 to Ser-39;
   (c) Ser-140 to Ala-153,
   (d) Arg-158 to Tyr-169;
   (e) Asp-175 to Ala-183;
   (f) Gly-216 to Asn-236;
   (g) Ala-261 to Leu-270;
   (h) Arg-282 to Phe-291;
   (i) Thr-297 to Ala-305;
   (j) Pro-342 to Gln-362;
   (k) Phe-455 to Asp-463;
   (l) His-497 to Thr-517;
   (m) Ala-521 to Gly-529;
   (n) Ile-537 to Val-546;
   (o) Ile-556 to Ala-568;
   (p) Pro-581 to Ser-595;
   (q) Glu-670 to Ala-685;
   (r) Ser-696 to Ala-705; and
   (s) Leu-782 to Ser-791.

12. The isolated polynucleotide of claim 11 which is fused to a heterologous polynucleotide sequence.

13. The isolated polynucleotide of claim 12 wherein said heterologous polynucleotide sequence encodes a polypeptide.

14. A method for making a recombinant vector comprising inserting the isolated polynucleotide of claim 11 into a vector.

15. A recombinant vector comprising the isolated polynucleotide of claim 11.

16. The recombinant vector of claim 15, wherein said polynucleotide is operably associated with a heterologous regulatory sequence that controls gene expression.

17. A recombinant host cell comprising the isolated polynucleotide of claim 11.

18. The recombinant host cell of claim 17 wherein said polynucleotide is operably associated with a heterologous regulatory sequence that controls gene expression.

19. A method for producing a polypeptide, comprising:
   (a) culturing a recombinant cell comprising the isolated polynucleotide of claim 11 under conditions suitable to produce a polypeptide encoded by said polynucleotide; and
   (b) recovering the polypeptide.

20. An isolated polynucleotide consisting of a nucleic acid sequence encoding an amino acid sequence consisting of a portion of SEQ ID NO:56, wherein said portion is at least 30 contiguous amino acid residues in length.

21. The isolated polynucleotide of claim 20, wherein said portion is at least 50 Contiguous amino acid residues in length.

22. The isolated polynucleotide of claim 21, wherein said portion is ay least 100 contiguous amino acid residues in length.

23. The isolated polynucleotide of claim 20, wherein said polynucleotide is fused to a heterologous polynucleotide sequence.

24. The isolated polynucleotide of claim 23, wherein said heterologous polynucleotide sequence encodes a polypeptide.

25. A method for making a recombinant vector comprising inserting the isolated polynucleotide of claim 20 into a vector.

26. A recombinant vector comprising the isolated polynucleotide of claim 20.

27. The recombinant vector of claim 26, wherein said polynucleotide is operably associated with a heterologous regulatory sequence that controls gene expression.

28. A recombinant host cell comprising the isolated polynucleotide of claim 20.

29. The recombinant host cell of claim 28, wherein said polynucleotide is operably associated with a heterologous regulatory sequence that controls gene expression.

30. A method for producing a polypeptide, comprising:
   (a) culturing a recombinant cell comprising the isolated polynucleotide of claim 20 under certain conditions suitable to produce a polypeptide encoded by said polynucleotide; and
   (b) recovering the polypeptide.

31. An isolated polynucleotide consisting of a nucleic acid molecule selected from the group consisting of:
   (a) SEQ ID NO:55; and
   (b) the full complement of (a).

32. The isolated polynucleotide of claim 31 which is fused to a heterologous polynucleotide sequence.

33. A method for making a recombinant vector comprising inserting the isolated polynucleotide of claim 31 into a vector.

34. A recombinant vector comprising the isolated polynucleotide of claim 31.

35. A recombinant host cell comprising the isolated polynucleotide of claim 31.

36. An isolated polynucleotide consisting of at least 50 contiguous nucleotides of a nucleic acid sequence selected from the group consisting of:
   (a) SEQ ID NO:55; and
   (b) the full complement of (a).

37. The isolated polynucleotide of claim 36, wherein said nucleic acid sequence is (a).

38. The isolated polynucleotide of claim 36, wherein said nucleic acid sequence is (b).

39. The isolated polynucleotide of claim 36, which is fused to a heterologous polynucleotide sequence.

40. A method for making a recombinant vector comprising inserting the isolated polynucleotide of claim 36 into a vector.

41. A recombinant vector comprising the isolated polynucleotide of claim 36.

42. A recombinant host cell comprising the isolated polynucleotide of claim 36.

43. A method of detecting *Streptococcus* nucleic acids in a biological sample obtained from an animal involving assaying for cue or more nucleic acid sequence encoding *Streptococcus* polypeptides in a sample comprising:

(a) contacting the sample with the isolated polynucleotide of claim 36, under conditions such that hybridization occurs, and (b) detecting hybridization of scud polynucleotide to the one or more *Streptococcus* nucleic acid sequences present in the biological sample.

* * * * *

UNITED STATES PATENT AND TRADEMARK OFFICE
CERTIFICATE OF CORRECTION

PATENT NO. : 6,887,663 B1
DATED : May 3, 2005
INVENTOR(S) : Choi et al.

It is certified that error appears in the above-identified patent and that said Letters Patent is hereby corrected as shown below:

Column 119,
Line 9, insert -- is -- between "polynucleotide" and "operably";
Line 40, delete "Thr-517" and insert -- Thr-511 --;

Column 120,
Line 12, delete "Contiguous amino acid" and insert -- contiguous amino acid --;
Line 15, delete "is ay least" and insert -- is at least --;
Line 36, delete "certain";

Column 121,
Line 7, delete "cue" and insert -- one --;

Column 122,
Line 4, delete "scud" and insert -- said --.

Signed and Sealed this

Sixth Day of September, 2005

JON W. DUDAS
*Director of the United States Patent and Trademark Office*